(12) United States Patent
Raab et al.

(10) Patent No.: US 10,047,352 B2
(45) Date of Patent: Aug. 14, 2018

(54) INTEIN-MODIFIED PROTEASES, THEIR PRODUCTION AND INDUSTRIAL APPLICATIONS

(71) Applicant: AGRIVIDA, INC., Medford, MA (US)

(72) Inventors: R. Michael Raab, Arlington, MA (US); Binzhang Shen, Boston, MA (US); Gabor Lazar, Belmont, MA (US); Humberto De La Vega, Peabody, MA (US)

(73) Assignee: AGRIVIDA, INC., Medford, MA (US)

( * ) Notice: Subject to any disclaimer, the term of this patent is extended or adjusted under 35 U.S.C. 154(b) by 0 days.

(21) Appl. No.: 14/433,104

(22) PCT Filed: Oct. 3, 2013

(86) PCT No.: PCT/US2013/063304
§ 371 (c)(1),
(2) Date: Apr. 2, 2015

(87) PCT Pub. No.: WO2014/055782
PCT Pub. Date: Apr. 10, 2014

(65) Prior Publication Data
US 2015/0232827 A1  Aug. 20, 2015

Related U.S. Application Data

(60) Provisional application No. 61/783,424, filed on Mar. 14, 2013, provisional application No. 61/744,863, filed on Oct. 3, 2012.

(51) Int. Cl.
| | |
|---|---|
| C12N 9/50 | (2006.01) |
| C12N 9/52 | (2006.01) |
| C12N 9/54 | (2006.01) |
| C12N 1/21 | (2006.01) |
| C12N 15/57 | (2006.01) |
| C07K 19/00 | (2006.01) |
| C11D 3/386 | (2006.01) |
| A23K 1/165 | (2006.01) |

(52) U.S. Cl.
CPC .............. *C12N 9/50* (2013.01); *A23K 1/1653* (2013.01); *C11D 3/386* (2013.01); *C12N 9/52* (2013.01); *C07K 2319/92* (2013.01)

(58) Field of Classification Search
None
See application file for complete search history.

(56) References Cited

U.S. PATENT DOCUMENTS

| 5,543,302 A * | 8/1996 | Boguslawski | C11D 3/38618 435/188 |
|---|---|---|---|
| 7,658,965 B2 * | 2/2010 | Sjoeholm | A23J 3/16 426/656 |
| 2003/0086918 A1 * | 5/2003 | Lima | C12N 15/62 424/94.63 |
| 2004/0091966 A1 * | 5/2004 | Zeidler | C12N 15/67 435/69.1 |
| 2006/0147499 A1 | 7/2006 | Oestergaard et al. | |
| 2008/0115243 A1 * | 5/2008 | Raab | C07K 14/505 800/288 |
| 2011/0111442 A1 | 5/2011 | Shen et al. | |
| 2011/0138502 A1 | 6/2011 | Raab | |
| 2015/0232507 A1 * | 8/2015 | Pallisse Bergwerf | C12P 21/06 530/350 |

FOREIGN PATENT DOCUMENTS

| EP | 0415296 B2 | 8/1990 |
|---|---|---|
| WO | 1998/55634 A1 | 12/1998 |
| WO | 2000/52155 A2 | 9/2000 |
| WO | 2003/066861 A1 | 8/2003 |
| WO | 20041034776 A2 | 4/2004 |
| WO | 2007/095398 A2 | 8/2007 |
| WO | 2011/057163 A2 | 5/2011 |
| WO | 2012/027395 A2 | 3/2012 |
| WO | 2012/042037 A1 | 4/2012 |
| WO | 2013/045632 A1 | 4/2013 |

OTHER PUBLICATIONS

Wang et al., Identification of an Unusual Intein in Chloroplast ClpP Protease of Chlamydomonas eugametos, J. Biol. Chem., 1997, 272, 11869-73.*
Dassa et al., Fractured genes: a novel genomic arrangement involving new split inteins and a new homing endonuclease family, Nucleic Acids Res., 2009, 37, 2560-73.*
Handler-Olsen et al., Regulation of matrix metalloproteinase activity in health and disease, FEBS J., 2011, 278, 28-45.*
Christiansen et al., Production of Savinase and Population Viability of Bacillus clausii During High-Cell-Density Fed-Batch Cultivations, Biotech. Bioeng., 2003, 83, 344-52.*
GenBank, Accession No. AP006627.1., 2009, www.ncbi.nlm.nih.gov.*
Uniprot, Accession No. P41362, 2011, www.uniprot.org.*
Xu et al., Green factory: Plants as bioproduction platforms for recombinant proteins, Biotech. Adv., Sep. 2011, 30, 1171-84.*
Skretas et al., Regulation of protein activity with small-molecule-controlled inteins, Protein Sci., 2004, 14, 523-532.*
Chong, S., et al., "Utilizing the C-Terminal Cleavage Activity of a Protein Splicing Element to Purify Recombinant Proteins in a Single Chromatographic Step" Nucleic Acids Research, Oct. 1, 1998, vol. 26, pp. 5109-5115; p. 5111, col. 1, paragraph 1, col. 2, paragraph 1.
Apgar, J., et al., "A Predictive Model of Intein Insertion Site for in the Engineering of Molecular Switches," PLoS ONE, May 23, 2012, vol. 7, No. 5; e34355, DOI: 10.1371/journal.pone,0037355.

(Continued)

Primary Examiner — Robert B Mondesi
Assistant Examiner — Todd Matthew Epstein
(74) Attorney, Agent, or Firm — Volpe and Koenig, P.C.

(57) ABSTRACT

Methods for producing intein-modified proteases are provided. Expression cassettes and vectors for using to genetically engineer hosts are described. Hosts genetically engineered to express one or more intein-modified proteases using expression cassettes and vectors of the invention are also provided. Methods to produce a protease and regulate its activity are described.

20 Claims, 20 Drawing Sheets

(56) References Cited

OTHER PUBLICATIONS

Fastrez, J., "Engineering Allosteric Regulation into Biological Catalysts," Chem Biochem., Nov. 24, 2009, vol. 10, No. 18, pp. 2824-2835; p. 2831, left column first paragraph; figure 4, DOI: 10.1002/cbic.200900590.
Wang et al. (2006) Beneficial Effects of Versazyme, a Keratinase Feed Additive, on Body Weight, Feed Conversion, and Breast Yield of Broiler Chickens. J. Appl. Poult. Res. 15, 544-550.
Woodard et al. (2003) Maize (Zea mays)-derived bovine trypsin: characterization of the first large-scale, commercial protein product from transgenic plants. Biotechnol Appl Biochem. Oct. 2003;38(Pt 2), 123-30.
Yabuta et al. (2001) Folding pathway mediated by an intramolecular chaperone. Propeptide-release modulates precise activation of a protease. J Biol Chem. 276, 44427-44434.
Yamabhai et al. (2008) Secretion of recombinant Bacillus hydrolytic enzymes using Escherichia coli expression systems. J Biotechnol. 133(1):50-57.
Yamazaki et al. (1998) Segmental isotope labeling for protein NMR using peptide splicing. J. Amer.Chem.Soc. 120, 5591-5592.
Yang et al. (2003) Intein-mediated assembly of a functional β-glucuronidase in transgenic plants. Proc. Natl. Acad. Sci. USA 100, 3513-3518.
Yeh et al. (2007) Extracellular production of a novel ice structuring protein by Bacillus subtilis; A case of recombinant food peptide additive production. Food Biotechnol. 21 (1-2), 119-128.
You and Arnold (1994) Directed evolution of subtilisin E in B.subtilis to enhance total activity in aqueous dimethylformamide. Protein Eng 1994, 9:77-83.
Zhao et al. (2004) Characterization of a neutral serine protease and its full-length cDNA from the nematode-trapping fungus Arthrobotrys oligospora. Mycologia 96, 16-22.
Baker, et al., "A protein-folding reaction under kinetic control", Nature (1992) 356:263-265.
Bonifait, et al., "The cell envelope subtilisin-like proteinase is a virulence determinant for Streptococcus suis", BMC Microbiology (2010) 10:42.
Brandelli, "Bacterial keratinases: Useful enzymes for bioprocessing agroindustrial wastes and beyond", Food Bioprocess Technol., (2008) 1:105-116.
Brandelli, et al., "Biochemical features of microbial keratinases and their production and application", Appl. Microbiol. Biotechnol. (2010) 85:1735-1750.
Bressollier, et al., "Purification and Characterization of a Keratinolytic Serine Proteinase from Streptomyces albidoflavus" Applied and Environmental Microbiology (1999) 65(6):2570-2576.
Carter and Wells, "Dissecting the catalytic triad of a serine protease", Nature (1988) 332:564-568.
Chin et al., "Protein trans-splicing in transgenic plant chloroplast: Reconstruction of herbicide resistance from split genes". Proc. Natl. Acad. Sci. USA, (2003) 100(8):4510-4515.
Cowieson and Adeola, "Carbohydrases, protease, and phytase have an additive beneficial effect in nutritional marginal diets for broiler chicks".(2005) Poultry Science 84, 1860-1867.
Cowieson et al., "The effect of conditioning temperature and exogenous xylanase addition on the viscosity of wheat-based diets and the performance of broiler chickens". (2005) British Poultry Science 46: 717-724.
Davis et al., "The controlled introduction of multiple negative charge at single amino acid sites in subtilisin Bacillus lentus". Bioorg Med Chem 1999, 7:2293-2301.
Fang et al., "Improvement of extracellular production of a thermophilic subtilase expressed in Escherichia coli by random mutagenesis of its N-terminal propeptide". (2010) Appl Microbiol Biotechnol. 85(5):1473-81.
Faye et al., "Protein modifications in the plant secretory pathway: current status and practical implications in molecular pharming". (2005) Vaccine, 23, 1770-1778.
Guoqiang et al., "A modified electro-transformation method for Bacillus subtilis and its application in the production of antimicrobial lipopeptides". (2011) Biotechnology Letters, 33 (5), 1047-1051.
Gupta R., "Ramnani P. Microbial keratinases and their prospective pplications: An overview". Appl. Microbiol. Biotechnol. (2006) 70 (1), 21-33.
Hood and Woodard, "Commercialization of a protein product from transgenic maize". (2005) Natl. Agric. Biotech. Council 17, 147-157.
Ishida et al., "High efficiency transformation of maize (Zea mays L.) mediated by Agrobacterium tumefaciens". (1996) Nature Biotech, 14(6), 745-750.
Ishida et al., "Agrobacterium-mediated transformation of maize". (2007)Nature Protocols, 2(7), 1614-1621.
Iwai et al., "Highly efficient protein trans-splicing by a naturally split DnaE intein from Nostoc punctiforme". (2006) FEBS Lett. 580(7), 1853-1858.
Jiang et al., "Effects of different levels of supplementary alpha-amylase on digestive enzyme activities and pancreatic amylase mRNA expression of young broilers". (2008) Asian-Austrialian Journal of Animal Science 21, 97-102.
Kempe et al. (2009) Intein-mediated protein assembly in transgenic wheat: production of active barnase and acetolactate synthase from split genes. Plant Biotechnology Journal, 7 (3), 283-297.
Komari et al. (2006) Methods in Molecular Biology, vol. 343, Agrobacterium Protocols, vol. 1, Binary Vectors and Super-binary Vectors, pp. 15-41. Humana Press Inc., 2 edition.
Legendre et al. (2000) Display of Active Subtilisin 309 on Phage: Analysis of Parameters Influencing the Selection of Subtilisin Variants with Changed Substrate Specificity from Libraries using Phosphonylating Inhibitors. J. Mol. Biol. (2000) 296, 87-102.
Li et al. (2004) Bottlenecks in the expression and secretion of heterologous proteins in Bacillus subtilis.; (2004) Res. Microbiol., 155 (8), 605-610.
Lin et al. (1992) Purification and Characterization of a Keratinase from a Feather-Degrading Bacillus licheniformis Strain. Applied and Environmental microbiology, 58 (10), 3271-3275.
Lin et al. (1997) Expression of the Bacillus licheniformis PWD-1 keratinase gene in B. subtilis. J. Ind. Microbiol. Biotechnol. 1997, 19 (2), 134-138.
Liu et al. (2008a) Effects of phytate and phytase on the performance and immune function of broilers fed nutritionally marginal diets. Poultry Science 87, 1105-1111.
Liu et al. (2008) Effect of diet containing phytate and phytase on the activity and mRNA expression of carbohydrate and transporter in chickens. Journal of Animal Science published online on Aug. 15, 2008 as doi: 10.2527/ias.2008-1234.
Lu et al. (2012) Study on the electro-transformation conditions of improving transformation efficiency for Bacillus subtilis. Lett Appl Microbiol, 55(1):9-14.
Mathlouthi et al. (2002) Xylanase, β-glucanase, and other side enzymatic activities have greater effects on viscosity of several feedstuffs than xylanase or β-glucanase used mlone or in combination. Journal of Agricultural and Food Chemistry 50: 5121-5127.
Odetallah et al. (2002a) Effect of natugrain enzyme preparation on the performance characteristics of tom turkeys fed wheat-based rations. Poult. Sci. 81, 987-994.
Odetallah et al. (2002) Effect of mannan-endo-1,4-β-mannosidase on the growh performance of turkeys fed diets containing 44% CP and 48% CP soybean meal. Poult. Sci. 81,1322-1331.
Odetallah et al. (2003) Keratinase in Starter Diets Improves Growth of Broiler Chicks. Poultry Science 82, 664-670.
Ohta et al. (1991) Pro-peptide as an intermolecular chaperone: renaturation of denatured subtilisin E with a synthetic pro-peptide. Mol Microbiol. 5, 1507-1510.
Otomo et al. (1999) NMR observation of selected segments in a larger protein: central-segment isotope labeling through intein-mediated ligation. Biochemistry 38, 16040-16044.
Phrommao et al. (2011) A novel subtilase with NaCl-activated and oxidant-stable activity from Virgibacillus sp. SK37. BMC Biotechnology 2011, 11:65-79.

(56) References Cited

OTHER PUBLICATIONS

Pierce et al. (1992) Physiological and genetic strategies for enhanced subtilisin production by Bacillus subtilis. Biotechnol. Prog. 8: 211-218.

Porres et al. (2002). Functional expression of keratinase (kerA) gene from Bacillus licheniformis in Pichia pastoris. Biotechnology Letters, 24, 631-636.

Privalle (2002) Phosphomannose isomerase, a novel plant selection system. Ann.N.Y.Acad.Sci. 964: 129-138.

Shinde and Inouye (1995) Folding pathway mediated by an intramolecular chaperone: characterization of the structural changes in pro-subtilisin E coincident with autoprocessing. J.Mol. Biol., 252, 25-30.

Short et al. (2002) The effect of a xylanase and protease enzyme on egg production in laying birds fed wheat based diets. Poult. Sci. 81(Suppl. 1):136. (Abstr.) Uni, Z., Y. Noy.

Siezen and Leunissen (1997) Subtiliases: the superfamily of subtilisin-like serine proteases. Protein Science 6, 501-523.

Simbaya et al. (1996) The effects of protease and carbohydrase supplementation on the nutritive value of canola meal for poultry: In vitro and in vivo studies. Animal feed Sci and Tech. 61, 219-234.

Sokol et al. (1979) More sensitive plate assay for detection of protease production by Pseudomonas aeruginosa. J. Clinical Microbiology 9(4), 538-540.

Stark et al. (2009) Evaluation of keratinase stability in pelleted broiler diets. J. Appl. Poult. Res. 18 :30-33.

Takagi and Takahashi (2003) A new approach for alteration of protease functions: pro-sequence engineering. Appl. Microbiol. Biotechnol. 63, 1-9.

Tiwary and Gupta (2010) Extracellular Expression of Keratinase from Bacillus licheniformis ER-15 in *Escherichia coli*. J. Agric. Food Chem., 58 (14), 8380-8385.

Vazqueza et al. (2004) Extracellular proteases from eight psychrotolerant antarctic strains; Microbiological Research 159:157-166.

Wang and Shih (1999) Fermentation production of keratinase from Bacillus licheniformis PWD-1 and a recombinant B. subtilis FDB-29. J. Industrial Microbiology and Biotechnology, 22, 608-616.

Wang et al. (2003). Bioimmobilization of keratinase using *Bacillus subtilis* and *Escherichia coli* systems. Biotechnology and Bioengineering, 81, 421-429.

Wang, et al. (2004), Increased production of Bacillus keratinase by chromosomal integration of multiple copies of the kerA gene. Biotechnol. Bioeng. (2004), 87 (4), 459-464.

Bedford and Partridge, "Enzymes in farm animal nutrition, 2nd edition". (2010) CAB International. Wallingford, Cambridge.

Carvajal-Vallejos et al., "Unprecedented Rates and Efficiencies Revealed for New Natural Split Inteins from Metagenomic Sources"; Journal of Biological Chemistry, vol. 287, No. 34, (Aug. 17, 2012), pp. 28686-28696.

Wood et al., "A genetic system yields self-cleaving inteins for bioseparations"; Nature Biotechnology (XP-002157634), vol. 17, Sep. 1999, pp. 889-892.

Zeidler et al., "Temperature-sensitive control of protein activity by conditionally splicing inteins"; Nature Biotechnology, vol. 22, No. 7, Jul. 2004.

European Search Report issued in EP 13843836.1.

\* cited by examiner

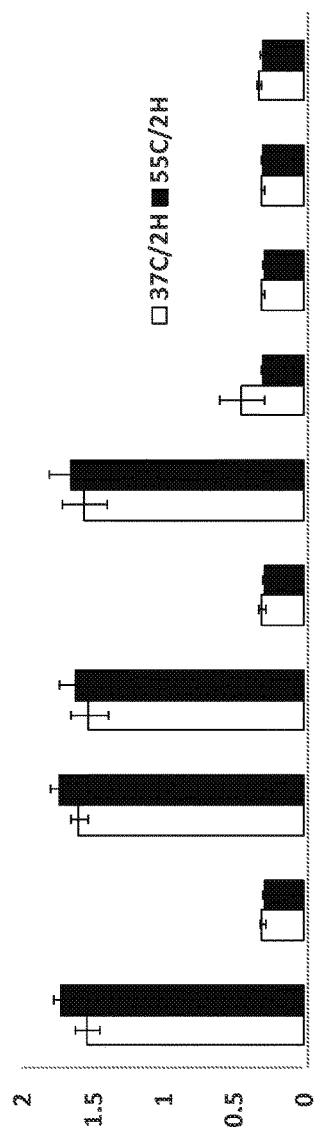
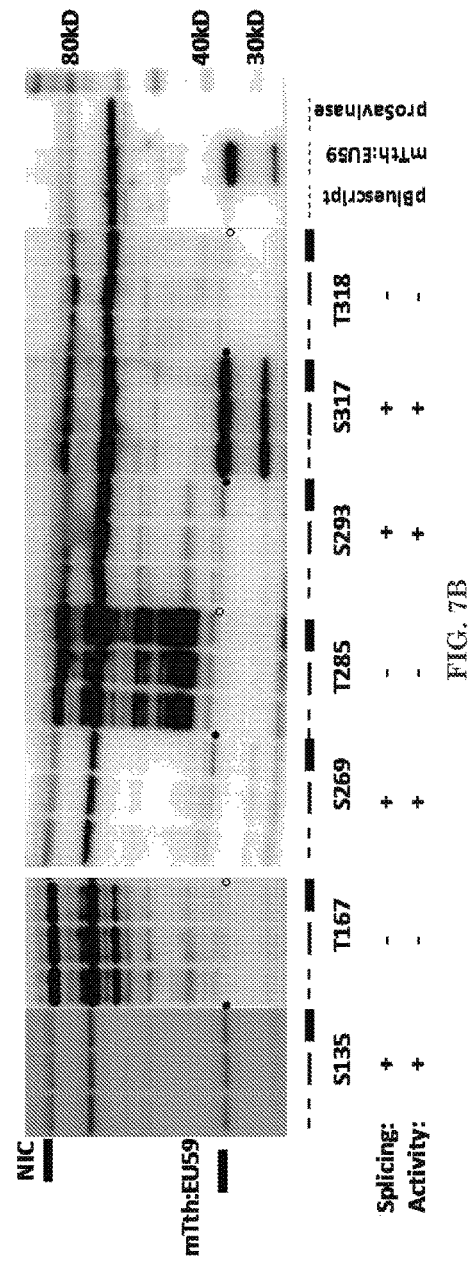
FIG. 7A
FIG. 7B

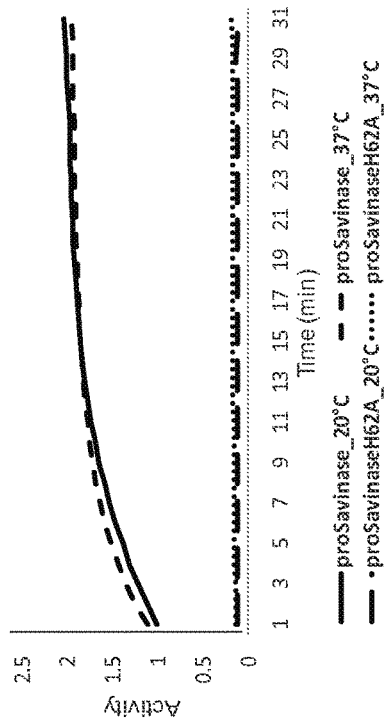
FIG. 18A
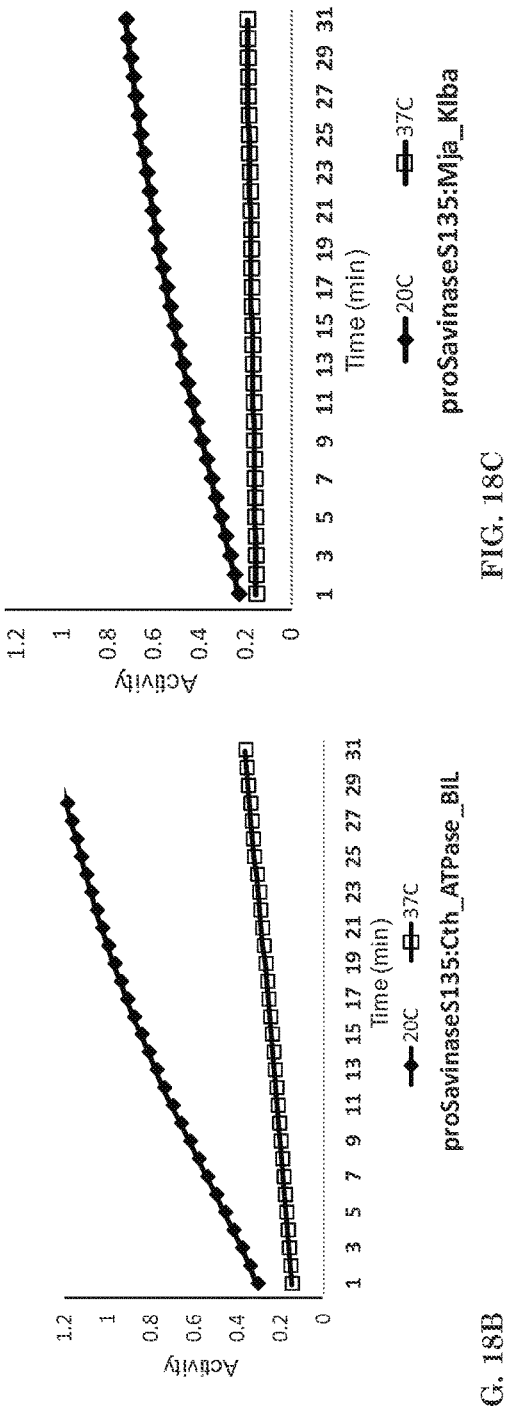
FIG. 18B
FIG. 18C

US 10,047,352 B2

INTEIN-MODIFIED PROTEASES, THEIR PRODUCTION AND INDUSTRIAL APPLICATIONS

This application is a 35 U.S.C. § 371 national phase application of PCT/US2013/063304, which was filed Oct. 3, 2013, and claims the benefit of U.S. provisional application No. 61/744,863 filed Oct. 3, 2012 and U.S. provisional application No. 61/783,424, filed Mar. 14, 2013, all of which are incorporated herein by reference as if fully set forth.

The sequence listing electronically filed with this application titled "Sequence Listing," which was created on Oct. 3, 2012 and had a size of 3,246,349 bytes, is incorporated by reference herein as if fully set forth.

FIELD OF INVENTION

The disclosure relates to intein-modified proteases, methods of producing intein-modified proteases, methods of producing proteases, and uses of intein-modified proteases.

BACKGROUND

Proteases are enzymes that hydrolyze proteins and polypeptides into smaller peptides and amino acids. Proteases have found wide use in industry, particularly in fabric care, detergents, dish washing liquids, industrial cleaners, in solutions for biofilm removal, and in animal feed. Proteases are often formulated in or added to detergents as stain removal agents when washing fabrics and clothing, or in liquid cleaners for washing dishes and other items. Proteases are also fed to animals to help them digest proteins within their diets. Despite these beneficial uses of proteases, these enzymes can be very difficult to produce because they not only degrade other proteins, but can also degrade themselves. For these reasons, only a very few specific proteases have found commercial use. A technology that could modulate protease activity, either during expression, purification, formulation, in a final product, or during an industrial, agricultural, consumer, home care, or feed process would have value in improving protease use and discovering new proteases with improved properties.

SUMMARY

An aspect of the invention relates to an intein-modified protease. The intein modified protease includes a target protease and an intein fused to the target protease. The intein is fused to the target protease in such a position as to control the activity of the target protease. The intein is capable of effecting splicing of the intein-modified protease.

An aspect of the invention relates to an expression cassette. The expression cassette includes a polynucleotide encoding an intein-modified protease. The intein-modified protease includes a target protease and an intein fused to the target protease. The intein is fused to the target protease in such a position as to control the activity of the target protease. The intein is capable of effecting splicing of the intein-modified protease.

An aspect of the invention relates to an expression cassette. The expression cassette includes a polynucleotide having a sequence with at least 90% identity to a reference sequence selected from the group consisting of SEQ ID NO: 44 (pAG2209), SEQ ID NO: 45 (pAG2210), SEQ ID NO: 46 (pAG2211), SEQ ID NO: 47 (pAG2212), SEQ ID NO: 48 (pAG2216), SEQ ID NO: 49 (pAG2217), SEQ ID NO: 50 (pAG2218), SEQ ID NO: 51 (pAG2219), SEQ ID NO: 52 (pAG2220), SEQ ID NO: 53 (pAG2221), SEQ ID NO: 54 (pAG2222), and SEQ ID NO: 55 (pAG2223).

An aspect of the invention relates to an expression cassette. The expression cassette includes a polynucleotide having a sequence with at least 90% identity to a reference sequence of SEQ ID NO: 629 (pET22_iSAV_Hwa_S317_nuc) or SEQ ID NO: 630 (P416GALL-Ura).

An aspect of the invention relates to a host genetically engineered to express an intein-modified protease. The intein-modified protease includes a target protease and an intein fused to the target protease. The intein is fused to the target protease in such a position as to control the activity of the target protease. The intein is capable of effecting splicing of the intein-modified protease.

An aspect of the invention relates to a host that includes any one of the intein-modified proteases described herein.

An aspect of the invention relates to a method of producing a protease. The method includes causing splicing of an intein-modified protease. The intein-modified protease includes a target protease and an intein fused to the target protease in such a position as to regulate the activity of the target protease. The intein is capable of effecting splicing of the intein-modified protease.

An aspect of the invention relates to a method of regulating the activity of a protease. The method includes producing the protease by any method described herein.

An aspect of the invention relates to an animal feed that includes any one of the intein-modified proteases described herein.

An aspect of the invention relates to a detergent that includes any one of the intein-modified proteases described herein.

BRIEF DESCRIPTION OF THE DRAWINGS

The following detailed description of the embodiments of the present invention will be better understood when read in conjunction with the appended drawings. For the purpose of illustrating the invention, there are shown in the drawings embodiments which are presently preferred. It is understood, however, that the invention is not limited to the precise arrangements and instrumentalities shown. In the drawings:

FIGS. 7A-7B illustrate Western blots of intein splicing in proSavinase.

FIGS. 18A-18C illustrate a temperature induction assay for selected cis-splicing iSavinase constructs: proSavinaseS135:Cth_ATPase_BIL, proSavianseS135:Mja_Klba and control contructs, ProSavinase and inactive proSaviH62.

DETAILED DESCRIPTION OF EMBODIMENTS

Figure 1:
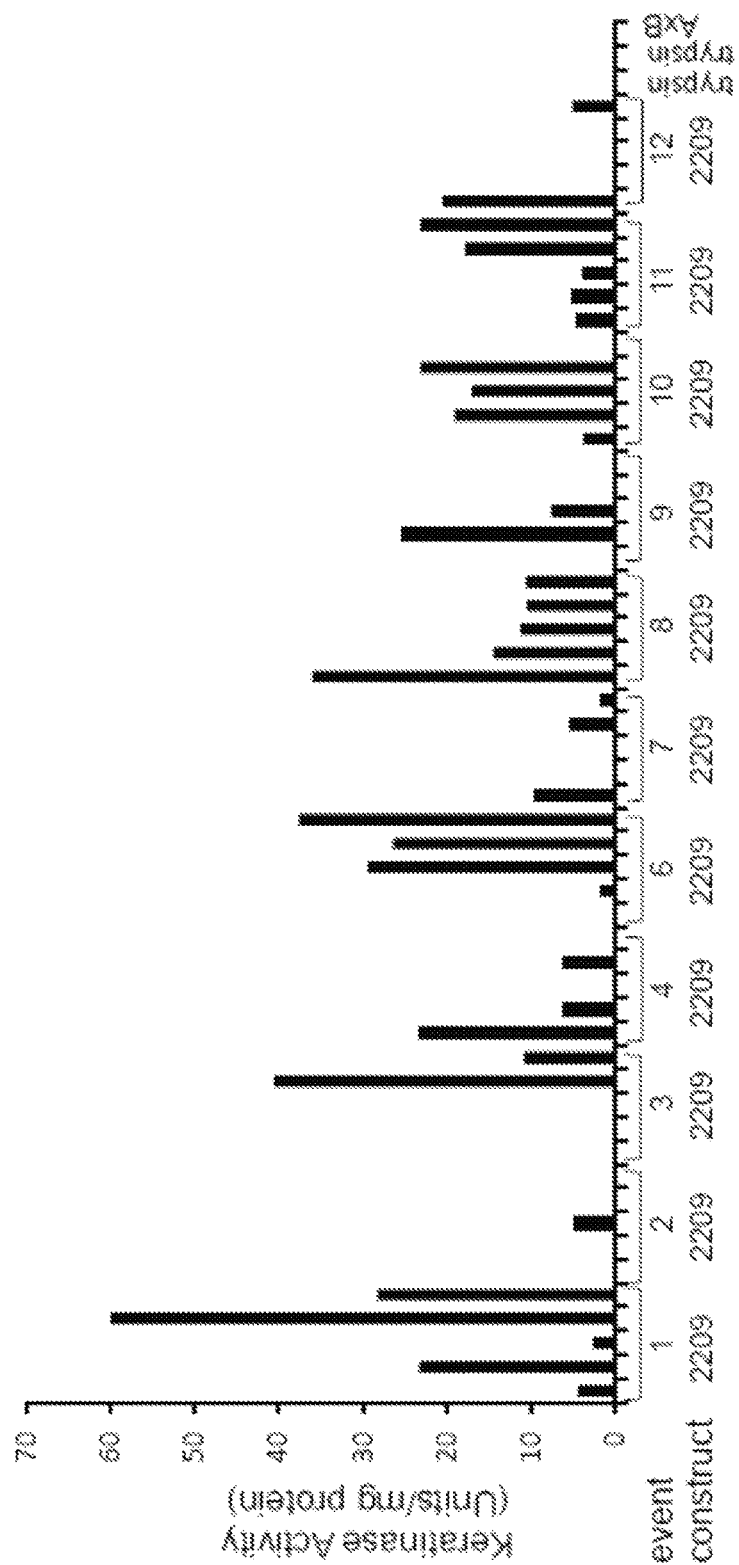
FIG. 1 illustrates Q53521 keratinase activity in T1 seeds of AB x 2209 events. Numbers 1 to 12 refer to T0 events produced from the construct pAG2209 (SEQ ID NO: 624).

Certain terminology is used in the following description for convenience only and is not limiting. The words "right," "left," "top," and "bottom" designate directions in the drawings to which reference is made. The words "a" and "one," as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

An embodiment includes an intein-modified protease. The intein-modified protease may include a target protease and an intein fused to the target protease in such a position as to control the activity of the target protease. The intein may be capable of effecting splicing of the modified protease. The intein may be fused to the target protease internally, meaning that the intein sequence is inserted into the target protease sequence. The intein may be fused to the target protease externally. An externally fused intein may be capable of effecting trans-splicing, or cis-splicing. An internally fused intein may be capable of effecting cis-splicing.

The intein may be fused in such a position as to substantially reduce or inhibit the activity of the target protease. A substantially reduced activity of the target protease may include activity reduced by 10, 15, 20, 25, 30, 35, 40 45, 50, 55, 60, 65, 70, 75, 80, 85, 90, 95, or 100% compared to the target protease, or a percentage in a range between any two of the figures. As used herein, "protease" refers to an enzyme or portion thereof that catalyzes hydrolysis of peptide bonds. The enzyme may be but is not limited to an amino acid sequence or protein herein having the activity of catalyzing hydrolysis of peptide bonds. The enzyme may be a variant of an amino acid sequence or protein herein and have the activity of catalyzing hydrolysis of peptide bonds, where the variant is a mutant and/or part of the amino acid sequence or protein. The variant may have at least 40% of the activity of the amino acid sequence or protein having the activity of catalyzing hydrolysis of peptide bonds.

The target protease may be an enzyme classified under EC 3.4 as peptide hydrolases. Within this classification, target proteases may include those classified under EC 3.4.99, EC 3.4.21.62, serine proteases, alkaline proteases, keratinases, and others. Other target proteases that may be part of an intein-modified protease herein include but are not limited to: metallo proteases, cysteine proteases, aspartate proteases, and ATP-dependent proteases. Proteases of Subtilisin family, Savinase, P29600 (SEQ ID NO: 1) and Keratinase, Q53521 (SEQ ID NOS: 12 and 621) may be a target protease in an intein-modified protease herein. While Savinase, P29600, may have a distinct application in fabric care and detergent products, it may also find applications in animal feed, where keratinases and Q53521 may be useful in feed products. Other target proteases may include Subtilisin from *B. lentus* (BL, P29599, SEQ ID NO: 2); Subtilisin from *B. pumilus* (PO7518, SEQ ID NO: 3); Subtilisin from *B. subtilis* (E, P04189, SEQ ID NO: 4); Subtilisin from *B. licheniformis* (DY, P00781, SEQ ID NO: 5); Subtilisin from *B. amyloliquefaciens* (BPN, P00782, SEQ ID NO: 6); Subtilisin from *Bacillus* sp. strain TA39 (P28842, SEQ ID NO:7); Subtilisin from *Geobacillus stearothermophilus* (J, P29142, SEQ ID NO: 8); Subtilisin from *B. subtilis* subsp. Natto (NAT, P35835, SEQ ID NO: 9); Subtilisin from *B. licheniformis* (Carlsberg, P00780, SEQ ID NO: 10); Subtilisin from *B. subtilis* subsp. Amylosachariticus, (amylosachariticus, P00780, SEQ ID NO: 11), and an acid fungal protease from *Trichoderma reesei* (SEQ ID NO: 718).

In an embodiment, the target protease of an intein-modified protease may comprise, consist essentially of, or consist of an amino acid sequence with at least 70, 72, 75, 80, 85, 90, 91, 92, 93, 94, 95, 96, 97, 98, 99, or 100% identity to a reference sequence selected from the group consisting of: SEQ ID NO: 1 (P29600), SEQ ID NO: 2 (P29599), SEQ ID NO: 3 (P07518), SEQ ID NO: 4 (P04189), SEQ ID NO: 5 (P00781), SEQ ID NO: 6 (P00782), SEQ ID NO: 7 (P28842), SEQ ID NO: 8 (P29142), SEQ ID NO: 9 (P35835), SEQ ID NO: 10 (P00780), SEQ ID NO: 11 (P00783), SEQ ID NO: 12 (Q53521), SEQ ID NO: 57 (ProSavinase), SEQ ID NO: 58 (Savinase catalytic domain), and SEQ ID NO: 718 (acid fungal protease).

Determining percent identity of two amino acid sequences or two nucleic acid sequences may include aligning and comparing the amino acid residues or nucleotides at corresponding positions in the two sequences. If all positions in two sequences are occupied by identical amino acid residues or nucleotides then the sequences are said to be 100% identical. Percent identity may be measured by the Smith Waterman algorithm (Smith T F, Waterman M S 1981 "Identification of Common Molecular Subsequences," J Mol Biol 147: 195-197, which is incorporated herein by reference as if fully set forth).

In an embodiment, a protease, which may be a target protease, having less than 100% identity to the cited amino acid reference sequence may be a variant of the protease having the amino acid reference sequence. In an embodiment, a polynucleotide sequence that encodes a protease having less than 100% identity to the protease encoded by the cited nucleic acid reference sequence may encode a variant of the protease encoded by the reference sequence. A variant of amino acid sequence or a protease may have at least 40% of the activity of the amino acid sequence or protease. A variant of the protease may be a part or a fragment of the protease. Fragments or parts thereof may include 100, 150, 200, 300, 400, 600, contiguous amino acids or more, such as 700. The functionality of proteases, which may be target proteases, variants or fragments, or parts thereof, may be determined using any known methods. The functionality of a protease may include the ability to hydrolyze peptide bonds. See, for example, methods to determine disclosed in Examples 7, 14, and 15 herein.

In an embodiment, a protease having a sequence with at least 70, 75, 80, 85, 90, 91, 92, 93, 94, 95, 96, 97, 98, 99, or 100% identity to a protease having the sequence of any one of SEQ ID NOS: 1-12, 57-58, and 718 along 6, 10 to 50, 10 to 100, 10 to 150, 10 to 300, 10 to 400, 10 to 500, 10 to 600, 10 to 700, 10 to 800, 10 to 900, or 10 to all amino acids of a protease having the sequence of any one of SEQ ID NOS: 1-12, 57-58, and 718 is provided. This list of sequence lengths encompasses every full length protease in SEQ ID NOS: 1-12, 57-58, and 718 and every smaller length within the list, even for proteases that do not include over 900 amino acids. For example, the lengths of 6, 10 to 50, 10 to 100, 10 to 150, 10 to 300, 10 to 400, and 10 to all amino acids would apply to a sequence with 453 amino acids. A range of amino acid sequence lengths recited herein includes every length of amino acid sequence within the range, endpoints inclusive. The recited length of amino acids may start at any single position within a reference sequence where enough amino acids follow the single position to accommodate the recited length, the range of sequence lengths can be extended by increments of 10 to 100N amino acids, where N=an integer of ten or greater.

A part of an amino acid sequence or a protease, which may be a target protease, may have at least 40% of the activity of the amino acid sequence or protease.

The intein may be any intein. Inteins are polypeptides that have the ability to cleave themselves from proteins post-translationally and may mediate ligation of the remaining protein fragments (the exteins), and may have the ability to cleave DNA at specific sites for their propagation. The inteins may be modified. The modified inteins may have the ability to cleave themselves but may lose their ability to cleave the DNA. The intein may be but is not limited to mTth, Pho_RadA, Tko_RadA, Sce_VMA, mVMA, and Pab_Lon. Intein sequences that may be in an intein-modified protease herein may be found in InBase, the intein database (http://www.neb.com/neb/inteins.html; Perler et al. 1992 Proc Natl Acad Sci USA 89: 5577), which is incorporated by reference herein as if fully set forth. Inteins that may be in an intein-modified protease may include but are not limited to the following: APMVPol (Acanthomoeba polyphaga Mimivirus), AbrPRP8 (Aspergillus brevipes FRR2439), Aca-JER2004PRP8 (Ajellomyces capsulatus), Aca-H143PRP8 (Ajellomyces capsulatus H143), Ade-ER3PRP8 (Ajellomyces dermatitidis ER-3), Aca-NAm1PRP8 (Ajellomyces capsulatus NAm1), Afu-Af293PRP8 (Aspergillus fumigatus var. ellipticus strain Af293), Ade-SLH14081PRP8 (Ajellomyces dermatitidis SLH14081), Afu-FRR0163PRP8 (Aspergillus fumigatus strain FRR0163), Afu-NRRL5109PRP8 (Aspergillus fumigatus var. ellipticus strain NRRL 5109), Ani-FGSCA4PRP8 (Aspergillus nidulans FGSC A), Agi-NRRL6136PRP8 (Aspergillus giganteus Strain NRRL 6136), AviPRP8 (Aspergillus viridinutans strain FRR0577), BciPRP8 (Botrytis cinerea), Bde-JEL423PRP8-1 (Batrachochytrium dendrobatidis JEL423), Bde-JEL197RPB2 (Batrachochytrium dendrobatidis JEL197), Bde-JEL423eIF-5B (Batrachochytrium dendrobatidis JEL423), Bde-JEL423PRP8-2 (Batrachochytrium dendrobatidis JEL423), Bfu-B05PRP8 (Botryotinia fuckeliana B05.10), Bde-JEL423RPC2 (Batrachochytrium dendrobatidis JEL423), CIVRIR1 (Chilo iridescent virus), CV-NY2AORF212392 (Chlorella virus NY2A), CV-NY2ARIR1 (Chlorella virus NY2A), CZIVRIR1 (Costelytra zealandica iridescent virus), Cba-WM02.98PRP8 (Cryptococcus bacillisporus strain WM02.98), Cba-WM728PRP8 (Cryptococcus bacillisporus strain WM728), CeuClpP (Chlamydomonas eugametos), CgaPRP8 (Cryptococcus gattii), CaPRP8 (Cryptococcus laurentii strain CBS139), CmoClpP (Chlamydomonas moewusii strain UTEX 97), CmoRPB2 (Chlamydomonas moewusii strain UTEX 97), CglVMA (Candida glabrata), CpaThrRS (Candida parapsilosis strain CLIB214), Fne-APRP8 (Filobasidiella neoformans Serotype A), Cne-JEC21PRP8 (Cryptococcus neoformans JEC21), Fne-AD-PRP8 (Cryptococcus neoformans Serotype AD), CreRPB2 (Chlamydomonas reinhardtii), CroVRPB2 (Cafeteria roenbergensis virus BV-PW1), CroVRIR1 (Cafeteria roenbergensis virus BV-PW1), CroVPol (Cafeteria roenbergensis virus BV-PW1), CroVTop2 (Cafeteria roenbergensis virus BV-PW1), CtrThrRS (Candida tropicalis ATCC750), CstRPB2 (Coelomomyces stegomyiae), CtrVMA (Candida tropicalis), DdiRPC2 (Dictyostelium discoideum strain AX4), DhanVMA (Debaryomyces hansenii CBS767), Ctr-MYA3404VMA (Candida tropicalis MYA-3404), DhanGLT1 (Debaryomyces hansenii CBS767), FteRPB2 (Floydiella terrestris strain UTEX 1709), GthDnaB (Guillardia theta), EniPRP8 (Emericella nidulans R20), Eni-FCSGA4PRP8 (Emericella nidulans FGSC A4), HaV01Pol (Heterosigma akashiwo virus 01), HcaPRP8 (Histoplasma capsulatum), IIV6RIR1 (Invertebrate iridescent virus 6), Kex-CBS379VMA (Kazachstania exigua strain CBS379), Kla-CBS683VMA (Kluyveromyces lactis strain CBS683), Kla-IFO1267VMA (Kluyveromyces lactis IFO1267), Kla-NRRLY1140VMA (Kluyveromyces lactis NRRL Y-1140), LelVMA (Lodderomyces elongisporus), NauPRP8 (Neosartorya aurata NRRL 4378), Mca-CBS113480PRP8 (Microsporum canis CBS 113480), NfiPRP8 (Neosartorya fischeri), Nfe-NRRL5534PRP8 (Neosartorya fennelliae NRRL 5534), Ngl-FRR1833PRP8 (Neosartorya glabra FRR1833), Ngl-FR2163PRP8 (Neosartorya glabra FRR2163), NquPRP8 (Neosartorya quadricincta strain NRRL 4175), NspiPRP8 (Neosartorya spinosa FRR4595), Pabr-Pb01PRP8 (Paracoccidioides brasiliensis Pb01), Pabr-Pb03PRP8 (Paracoccidioides brasiliensis Pb03), Pan-GLT1 (Podospora anserina), PanCHS2 (Podospora anserina), PchPRP8 (Penicillium chrysogenum), PblPRP8-a (Phycomyces blakesleeanus), Pbr-Pb18PRP8 (Paracoccidioides brasiliensis Pb18), PblPRP8-b (Phycomyces blakesleeanus), PexPRP8 (Penicillium expansum), PguGLT1 (Pichia guilliermondii), PnoGLT1 (Phaeosphaeria nodorum SN15), Pgu-altGLT1 (Pichia guilliermondii), PstVMA (Pichia stipitis CBS 6054), PnoRPA2 (Phaeosphaeria nodorum SN15), PpuDnaB (Porphyra purpurea), PtrPRP8 (Pyrenophora tritici-repentis Pt-IC-BF), PvuPRP8 (Penicillium vulpinum), PyeDnaB (Porphyra yezoensis), Sca-CBS4309VMA (Saccharomyces castellii strain CBS4309), SasRPB2 (Spiromyces aspiralis NRRL 22631), SceVMA, VMA (Saccharomyces cerevisiae), Sca-IFO1992VMA (Saccharomyces castellii strain IFO1992), Sce-DH1-1AVMA (Saccharomyces cerevisiae strain DH1-1A), ScarVMA (Saccharomyces cariocanus strain UFRJ 50791), Sce-Jay291VMA (Saccharomyces cerevisiae JAY291), Sce-YJM789VMA (*Saccharomyces cerevisiae* strain YJM789), Sce-OUT7091VMA (*Saccharomyces cerevisiae* OUT7091), Sce-OUT7112VMA (*Saccharomyces cerevisiae* OUT7112), SjaVMA (*Schizosaccharomyces japonicus* yFS275), Sex-IFO1128VMA (*Saccharomyces exiguus* strain IFO1128), SheRPB2 (*Stigeoclonium helveticum* strain UTEX 441), SdaVMA (*Saccharomyces dairenensis* strain CBS 421), SpaVMA (*Saccharomyces pastorianus* IFO11023), SpuPRP8 (*Spizellomyces punctatus*), SunVMA (*Saccharomyces unisporus* strain CBS 398), TglVMA (*Torulaspora globosa* strain CBS 764), TprVMA (*Torulaspora pretoriensis* strain CBS 5080), Ure-1704PRP8 (*Uncinocarpus reesii*), VpoVMA (*Vanderwaltozyma polyspora* strain CBS 2163), WIVRIR1 (*Wiseana iridescent* virus), ZroVMA (*Zygosaccharomyces rouxii* strain CBS 688), ZbiVMA (*Zygosaccharomyces bisporus* strain CBS 702), ZbaVMA (*Zygosaccharomyces bailii* strain CBS 685), AP-APSE1dpol (*Acyrthosiphon pisum* secondary endosymbiot phage 1), AP-APSE2dpol (Bacteriophage APSE-2), AP-APSE4dpol (*Candidatus Hamiltonella* defensa strain 5ATac bacteriophage), AP-APSE5dpol (Bacteriophage APSE-5), AP-Aaphi23MupF (Bacteriophage Aaphi23), AaeRIR2 (*Aquifex aeolicus* strain VF5), Aave-AAC001RIR1 (*Acidovorax avenae* subsp. *citrulli* AAC00-1), Aave-AAC001Aave1721 (*Acidovorax avenae* subsp. *citrulli* AAC00-1), Aave-ATCC19860RIR1 (*Acidovorax avenae* subsp. *avenae* ATCC 19860), AbaHyp-02185 (*Acinetobacter baumannii* ACICU), AceRIR1 (*Acidothermus cellulolyticus* 11B), AehDnaB-1 (*Alkalilimnicola ehrlichei* MLHE-1), AehDnaB-2 (*Alkalilimnicola ehrlichei* MLHE-1), AehRirl (*Alkalilimnicola ehrlichei* MLHE-1), MupF-MupF (*Aggregatibacter* phage S1249), AhaDnaE-c (*Aphanothece halophytica*), AhaDnaE-n (*Aphanothece halophytica*), Alvi-DSM180GyrA (*Allochromatium vinosum* DSM 180), AmaMADE823 (*Alteromonas macleodii*), Amax-CS328DnaX (*Arthrospira maxima* CS-328), AovDnaE-c (*Aphanizomenon ovalisporum*), AovDnaE-n (*Aphanizomenon ovalisporum*), Apl-C1DnaX (*Arthrospira platensis*), AspDnaE-c (*Anabaena* species PCC7120), Arsp-FB24DnaB (*Arthrobacter* species FB24), AspDnaE-n (*Anabaena* species PCC7120), AvaDnaE-c (*Anabaena variabilis* ATCC29413), AvinRIR1BIL (*Azotobacter vinelandii*), AvaDnaE-n (*Anabaena variabilis* ATCC29413), Bce-MCO3DnaB (*Burkholderia cenocepacia* MCO-3), Bce-PC184DnaB (*Burkholderia cenocepacia* PC184), Bse-MLS10TerA (*Bacillus selenitireducens* MLS10), BsuP-M1918RIR1 (*B. subtilis* M1918 prophage), BsuP-SPBc2RIR1 (*B. subtilis* strain 168 Sp beta c2 prophage), Bcep1808_7358 (*Burkholderia vietnamiensis* G4), CP-P1201Thy1 (*Corynebacterium* phage P1201), CagRIR1 (*Chlorochromatium aggregatum*), CauSpoVR (*Chloroflexus aurantiacus* J-10-fl), CbP-C-StRNR (*Clostridium botulinum* phage C-St), CbP-D1873RNR (*Clostridium botulinum* phage D), Cbu-DugwayDnaB (*Coxiella burnetii* Dugway 5J108-111), Cbu-GoatDnaB (*Coxiella burnetii* MSU Goat Q177), Cbu-RSA334DnaB (*Coxiella burnetii* RSA 334), Cbu-RSA493DnaB (*Coxiella burnetii* RSA 493), CceHyp1-Csp-2 (*Cyanothece* sp. ATCC 51142), CchRIR1 (*Chlorobium chlorochromatii* CaD3), CcyHyp1-Csp-1 (*Cyanothece* sp. CCY0110), CcyHyp1-Csp-2 (*Cyanothece* sp. CCY0110), Cfl-DSM20109DnaB (*Cellulomonas flavigena* DSM 20109), ChyRIR1 (*Carboxydothermus hydrogenoformans* Z-2901), CklPTerm (*Clostridium kluyveri* DSM 555), Cra-CS505DnaE-c (*Cylindrospermopsis raciborskii* CS-505), Cra-CS505DnaE-n (*Cylindrospermopsis raciborskii* CS-505), Cra-CS505GyrB (*Cylindrospermopsis raciborskii* CS-505), Csp-CCY0110DnaE-c (*Cyanothece* sp. CCY0110), Csp-CCY0110DnaE-n (*Cyanothece* sp. CCY0110), Csp-PCC7424DnaE-c (*Cyanothece* sp. PCC 7424), Csp-PCC7424DnaE-n (*Cyanothece* sp. PCC 7424), Csp-PCC7425DnaB (*Cyanothece* sp. PCC 7425), Csp-PCC7822DnaE-n (*Cyanothece* sp. PCC 7822), Csp-PCC8801DnaE-c (*Cyanothece* sp. PCC 8801), Csp-PCC8801DnaE-n (*Cyanothece* sp. PCC 8801), CthATPaseBIL (*Clostridium thermocellum*), Cth-ATCC27405TerA (*Clostridium thermocellum* ATCC27405), Cth-DSM2360TerA (*Clostridium thermocellum* DSM 2360), CwaDnaB (*Crocosphaera watsonii* WH 8501), CwaDnaE-c (*Crocosphaera watsonii* WH 8501), CwaDnaE-n (*Crocosphaera watsonii* WH 8501), CwaPEP (*Crocosphaera watsonii* WH 8501), CwaRIR1 (*Crocosphaera watsonii* WH 8501), DaudRIR1 (*Candidatus Desulforudis* audaxviator MP104C), DgeDnaB (*Deinococcus geothermalis* DSM11300), Dha-DCB2RIR1 (*Desulfitobacterium hafniense* DCB-2), Dha-Y51RIR1 (*Desulfitobacterium hafniense* Y51), Dpr-MLMS1RIR1 (delta proteobacterium MLMS-1), DraRIR1 (*Deinococcus radiodurans* R1 TIGR strain), DraSnf2-c (*Deinococcus radiodurans* R1 TIGR strain), Snf2-nN-TERM (*Deinococcus radiodurans* R1 TIGR strain), Dra-ATCC13939Snf2 (*Deinococcus radiodurans* R1 ATCC13939 Brooks & Murray strain), UDPGD (*Dictyoglomus thermophilum* H-6-12), DvulParB (*Desulfovibrio vulgaris* subsp. *vulgaris* DP4), EP-Min27Primase (*Enterobacteria* phage Min27), FalDnaB (*Frankia alni* ACN14a), Fsp-CcI3RIR1 (*Frankia* species CcI3), GobDnaE (*Gemmata obscuriglobus* UQM2246), GobHyp (*Gemmata obscuriglobus* UQM2246), GviDnaB (*Gloeobacter violaceus* PCC 7421), GviRIR1-2 (*Gloeobacter violaceus* PCC 7421), GviRIR1-1 (*Gloeobacter violaceus* PCC 7421), HhalDnaB (*Halorhodospira halophila* SL1), Kfl-DSM17836DnaB (*Kribbella flavida* DSM 17836), KraDnaB (*Kineococcus radiotolerans* SRS30216), LLP-KSY1PolA (*Lactococcus* phage KSY1), LP-phiHSIChelicase (*Listonella pelagia* phage phiHSIC), Lsp-PCC8106GyrB (*Lyngbya* sp. PCC 8106), MP-BeDnaB (Mycobacteriophage Bethlehem), MP-Begp51 (Mycobacteriophage Bethlehem), MP-Cateragp206 (Mycobacteriophage Catera), MP-KB-Ggp53 (*Mycobacterium* phage KBG), MP-OmegaDnaB (Mycobacteriophage Omega), MP-Mcjw1DnaB (Mycobacteriophage CJW1), gp50 (Mycobacteriophage U2), Maer-NIES843DnaB (*Microcystis aeruginosa* NIES-843), Maer-NIES843DnaE-c (*Microcystis aeruginosa* NIES-843), Maer-NIES843DnaE-n (*Microcystis aeruginosa* NIES-843), Mau-ATCC27029GyrA (*Micromonospora aurantiaca* ATCC 27029), Mav-104DnaB (*Mycobacterium avium* 104), Mav-ATCC25291DnaB (*Mycobacterium avium* subsp. *avium* ATCC 25291), Mav-ATCC35712DnaB (*Mycobacterium avium*), Mav-PTDnaB (*Mycobacterium avium* subsp. *paratuberculosis* str. k10), MboPps1 (*Mycobacterium bovis* subsp. *bovis* AF2122/97), MboRecA (*Mycobacterium bovis* subsp. *bovis* AF2122/97), MboPps1 (*Mycobacterium bovis* subsp. *bovis* AF2122/97), Mbo-AF2122DnaB (*Mycobacterium bovis* subsp. *bovis* AF2122/97), Mbo-1173PDnaB (*Mycobacterium bovis* BCG Pasteur 1173P), McaMupF (*Methylococcus capsulatus* Bath prophage MuMc02), McaRIR1 (*Methylococcus capsulatus* Bath), MchRecA (*Mycobacterium chitae*), Mcht-PCC7420DnaE-1 (*Microcoleus chthonoplastes* PCC7420), Mcht-PCC7420DnaE-2c (*Microcoleus chthonoplastes* PCC7420), Mcht-PCC7420DnaE-2n (*Microcoleus chthonoplastes* PCC7420), Mcht-PCC7420GyrB (*Microcoleus chthonoplastes* PCC7420), Mcht-PCC7420RIR1-1 (*Microcoleus chthonoplastes* PCC7420), Mcht-PCC7420RIR1-2 (*Microcoleus chthonoplastes* PCC7420), Mexhelicase (*Methylobacterium*

*extorquens* AM1), MexTrbC (*Methylobacterium extorquens* AM1), MfaRecA (*Mycobacterium fallax*), MflGyrA (*Mycobacterium flavescens* Fla0), MflRecA (*Mycobacterium flavescens* Fla0), Mfl-ATCC14474RecA (*Mycobacterium flavescens* ATCC14474), Mfl-PYR-GCKDnaB (*Mycobacterium flavescens* PYR-GCK), MgaGyrA (*Mycobacterium gastri*), MgaRecA (*Mycobacterium gastri*), MgaPps1 (*Mycobacterium gastri*), Mgi-PYR-GCKDnaB (*Mycobacterium gilvum* PYR-GCK), Mgi-PYR-GCKGyrA (*Mycobacterium gilvum* PYR-GCK), MgoGyrA (*Mycobacterium gordonae*), Min-1442DnaB (*Mycobacterium intracellulare*), Min-ATCC13950GyrA (*Mycobacterium intracellulare* ATCC 13950), MkasGyrA (*Mycobacterium kansasii*), Mkas-ATCC12478GyrA (*Mycobacterium kansasii* ATCC 12478), Mle-Br4923GyrA (*Mycobacterium leprae* Br4923), Mle-TNDnaB (*Mycobacterium leprae* strain TN), Mle-TNGyrA (*Mycobacterium leprae* TN), MlePps1 (*Mycobacterium leprae*), Mle-TNRecA (*Mycobacterium leprae* strain TN), MmaGyrA (*Mycobacterium malmoense*), MmagMagn8951BIL (*Magnetospirillum magnetotacticum* MS-1), MshRecA (*Mycobacterium shimodei*), MsmDnaB-1 (*Mycobacterium smegmatis* MC2 155), MsmDnaB-2 (*Mycobacterium smegmatis* MC2 155), Msp-KMSDnaB (*Mycobacterium* species KMS), Msp_KMSGyrA (*Mycobacterium* species KMS), Msp-MCSDnaB (*Mycobacterium* species MCS), Msp_MCSGyrA (*Mycobacterium* species MCS), MtheRecA (*Mycobacterium thermoresistibile*), MtuPps1 (*Mycobacterium tuberculosis* strain H37Rv), Mtu-CDC1551DnaB (*Mycobacterium tuberculosis* CDC1551), Mtu-CRecA (*Mycobacterium tuberculosis* C), Mtu-CPHL-RecA (*Mycobacterium tuberculosis* CPHL_A), Mtu-EAS054RecA (*Mycobacterium tuberculosis* EAS054), Mtu-CanettiRecA (*Mycobacterium tuberculosis* strain Canetti), Mtu-F11DnaB (*Mycobacterium tuberculosis* strain F11), Mtu-H37RaDnaB (*Mycobacterium tuberculosis* H37Ra), Mtu-H37RvDnaB (*Mycobacterium tuberculosis* H37Rv), Mtu-H37RvRecA (*Mycobacterium tuberculosis* H37Rv, Also CDC1551), Mtu-HaarlemDnaB (*Mycobacterium tuberculosis* str. Haarlem), Mtu-R604RecA-n (*Mycobacterium tuberculosis* 98-R604 INH-RIF-EM), Mtu-K85RecA (*Mycobacterium tuberculosis* K85), Mtu-So93RecA (*Mycobacterium tuberculosis* So93/sub_species Canetti), Mtu-T17RecA-c (*Mycobacterium tuberculosis* T17), Mtu-T17RecA-n (*Mycobacterium tuberculosis* T17), Mtu-T46RecA (*Mycobacterium tuberculosis* T46), Mtu-T85RecA (*Mycobacterium tuberculosis* T85), MvanDnaB (*Mycobacterium vanbaalenii* PYR-1), Mtu-T92RecA (*Mycobacterium tuberculosis* T92), MvanGyrA (*Mycobacterium vanbaalenii* PYR-1), MxaRAD25 (*Myxococcus xanthus* DK1622), MxeGyrA (*Mycobacterium xenopi* strain IMM5024), Naz-0708RIR1-2 (*Nostoc azollae* 0708), Naz-0708RIR1-1 (*Nostoc azollae* 0708), NfaDnaB (*Nocardia farcinica* IFM 10152), NfaNfa15250 (*Nocardia farcinica* IFM 10152), NfaRIR1 (*Nocardia farcinica* IFM 10152), Nosp-CCY9414DnaE-n (*Nodularia spumigena* CCY9414), NpuDnaB (*Nostoc punctiforme*), NpuGyrB (*Nostoc punctiforme*), Npu-PCC73102DnaE-c (*Nostoc punctiforme* PCC73102), Npu-PCC73102DnaE-n (*Nostoc punctiforme* PCC73102), Nsp-JS614DnaB (*Nocardioides* species JS614), Nsp-JS614TOPRIM (*Nocardioides* species JS614), Nsp-PCC7120DnaB (*Nostoc* species PCC7120), Nsp-PCC7120DnaE-c (*Nostoc* species PCC7120), Nsp-PCC7120DnaE-n (*Nostoc* species PCC7120), Nsp-PCC7120RIR1 (*Nostoc* species PCC7120), OliDnaE-c (*Oscillatoria limnetica* str. Solar Lake), OliDnaE-n (*Oscillatoria limnetica* str. Solar Lake), PP-PhiELHelicase (*Pseudomonas aeruginosa* phage phiEL), PP-PhiELORF11 (*Pseudomonas aeruginosa* phage phiEL), PP-PhiELORF40 (*Pseudomonas aeruginosa* phage phiEL), PP-PhiELORF39 (*Pseudomonas aeruginosa* phage phiEL), PflFhaBIL (*Pseudomonas fluorescens* Pf-5), Pma-ExH1DnaE (*Persephonella marina* EX-H1), PlutRIR1 (*Pelodictyon luteolum* DSM 273), Pma-EXH1GyrA (*Persephonella marina* EX-H1), PnaRIR1 (*Polaromonas naphthalenivorans* CJ2), Posp-JS666DnaB (*Polaromonas* species JS666), PuncDnaB (*Polynucleobacter* sp. QLW-P1DMWA-1), Posp-JS666RIR1 (*Polaromonas* species JS666), Pssp-A1-1Fha (*Pseudomonas* species A1-1), PsyFha (*Pseudomonas syringae* pv. tomato str. DC3000), Rbr-D9GyrB (*Raphidiopsis brookii* D9), RceRIR1 (*Rhodospirillum centenum* SW), Rer-SK121DnaB (*Rhodococcus erythropolis* SK121), Rma-DnaB (*Rhodothermus marinus*), Rma-DSM4252DnaE (*Rhodothermus marinus* DSM 4252), Rma-DSM4252DnaB (*Rhodothermus marinus* DSM 4252), RspRir1 (*Roseovarius* species 217), SaP-SETP12dpol (*Salmonella* phage SETP12), SaP-SETP3Helicase (*Salmonella* phage SETP3), SaP-SETP3dpol (*Salmonella* phage SETP3), SaP-SETP5dpol (*Salmonella* phage SETP5), SareDnaB (*Salinispora arenicola* CNS-205), ReGHelicase (*Streptomyces avermitilis* MA-4680), Sel-PC6301RIR1 (*Synechococcus elongatus* PCC 6301), Sel-PC7942DnaE-c (*Synechococcus elongatus* PC7942), Sel-PC7942RIR1 (*Synechococcus elongatus* PC7942), Sel-PC7942DnaE-n (*Synechococcus elongatus* PC7942), Sel-PCC6301DnaE-n (*Synechococcus elongatus* PCC 6301), Sel-PCC6301DnaE-c (*Synechococcus elongatus* PCC 6301 and PCC7942), ShP-Sfv-2a-2457T-nPrimase (*Shigella flexneri* 2a str. 2457T), SepRIR1 (*Staphylococcus epidermidis* RP62A), ShP-Sfv-2a-301Primase (*Shigella flexneri* 2a str. 301), ShP-Sfv-5Primase (*Shigella flexneri* 5 str. 8401), SoP-SO1dpol (*Sodalis* phage SO-1), SruDnaB (*Salinibacter ruber* DSM 13855), SplDnaX (*Spirulina platensis* strain C1), SruPolBc (*Salinibacter ruber* DSM 13855), SruRIR1 (*Salinibacter ruber* DSM 13855), SspDnaB (*Synechocystis* species strain PCC6803), SspDnaE-n, DnaE-N (*Synechocystis* species strain PCC6803), SspDnaE-c, DnaE-C(*Synechocystis* species strain PCC6803), SspDnaX (*Synechocystis* species strain PCC6803), Ssp-JA2RIR1 (*Synechococcus* species JA-2-3B a 2-13), Ssp-JA2DnaB (*Synechococcus* species JA-2-3B a 2-13), SspGyrB (*Synechocystis* species strain PCC6803), Ssp-JA3DnaB (*Synechococcus* species JA-3-3Ab), Ssp-JA3RIR1 (*Synechococcus* species JA-3-3Ab), Ssp-PCC7002DnaE-c (*Synechocystis* species strain PCC 7002), Ssp-PCC7002DnaE-n (*Synechocystis* species strain PCC 7002), Ssp-PCC7335RIR1 (*Synechococcus* sp. PCC 7335), StP-TwortORF6 (*Staphylococcus* phage Twort), Susp-NBC371DnaB (*Sulfurovum* sp. NBC37-1), Taq-Y51MC23DnaE (*Thermus aquaticus* Y51MC23), TelDnaE-c (*Thermosynechococcus elongatus* BP-1), Tcu-DSM43183RecA (*Thermomonospora curvata* DSM 43183), TelDnaE-n (*Thermosynechococcus elongatus* BP-1), Taq-Y51MC23RIR1 (*Thermus aquaticus* Y51MC23), TerDnaB-1 (*Trichodesmium erythraeum* IMS101), TerDnaB-2 (*Trichodesmium erythraeum* IMS101), TerDnaE-2 (*Trichodesmium erythraeum* IMS101), TerDnaE-1 (*Trichodesmium erythraeum* IMS101), TerDnaE-3c (*Trichodesmium erythraeum* IMS101), TerDnaE-3n (*Trichodesmium erythraeum* IMS101), TerGyrB (*Trichodesmium erythraeum* IMS101), TerNdse-1 (*Trichodesmium erythraeum* IMS101), TerNdse-2 (*Trichodesmium erythraeum* IMS101), TerRIR-1 (*Trichodesmium erythraeum* IMS101), TerRIR-2 (*Trichodesmium erythraeum* IMS101), TerRIR-3 (*Trichodesmium erythraeum* IMS101), TerRIR-4 (*Trichodesmium erythraeum* IMS101), TerSnf2 (*Trichodes*- mium erythraeum IMS101), TerThyX (*Trichodesmium erythraeum* IMS101), TfusRecA-1 (*Thermobifida fusca* YX), TfusRecA-2 (*Thermobifida fusca* YX), TfusTfu2914 (*Thermobifida fusca* YX), Thsp-K90RIR1 (*Thioalkalivibrio* sp. K90mix), Tth-DSM571RIR1 (*Thermoanaerobacterium thermosaccharolyticum* DSM 571), Tth-HB27DnaE-1, Tth (*Thermus thermophilus* HB27), Tth-HB27DnaE-2 (*Thermus thermophilus* HB27), Tth-HB27RIR1-1 (*Thermus thermophilus* HB27), Tth-HB27RIR1-2 (*Thermus thermophilus* HB27), Tth-HB8DnaE-1 (*Thermus thermophilus* HB8), Tth-HB8DnaE-2 (*Thermus thermophilus* HB8), Tth-HB8RIR1-1 (*Thermus thermophilus* HB8), Tth-HB8RIR1-2 (*Thermus thermophilus* HB8), TvuDnaE-c (*Thermosynechococcus vulcanus*), TvuDnaE-n (*Thermosynechococcus vulcanus*), TyeRNR-1 (*Thermodesulfovibrio yellowstonii* DSM 11347), TyeRNR-2 (*Thermodesulfovibrio yellowstonii* DSM 11347), ApeAPE0745 (*Aeropyrum pernix* K1), Cme-booPol-II (*Candidatus Methanoregula boonei* 6A8), Fac-FerlRIR1 (*Ferroplasma acidarmanus* taxon:97393), FacPps1 (*Ferroplasma acidarmanus*), Fac-TypeIRIR1 (*Ferroplasma acidarmanus* type I), FacPps1 (*Ferroplasma acidarmanus*), HmaCDC21 (*Haloarcula marismortui* ATCC 43049), HmaPol-II (*Haloarcula marismortui* ATCC 43049), HmaPolB (*Haloarcula marismortui* ATCC 43049), HmaTopA (*Haloarcula marismortui* ATCC 43049), Hmu-DSM12286MCM (*Halomicrobium mukohataei* DSM 12286), Hmu-DSM12286PoB (*Halomicrobium mukohataei* DSM 12286), Hsa-R1MCM (*Halobacterium salinarum* R-1), Hsp-NRC1CDC21 (*Halobacterium* species NRC-1), Hsp-NRC1Pol-II (*Halobacterium salinarum* NRC-1), Hut-MCM-2 (*Halorhabdus utahensis* DSM 12940), HutMCM-1 (*Halorhabdus utahensis* DSM 12940), HwaGyrB (*Haloquadratum walsbyi* DSM 16790), HvoPolB (*Haloferax volcanii* DS70), HwaMCM-1 (*Haloquadratum walsbyi* DSM 16790), HwaMCM-2 (*Haloquadratum walsbyi* DSM 16790), HwaMCM-3 (*Haloquadratum walsbyi* DSM 16790), HwaMCM-4 (*Haloquadratum walsbyi* DSM 16790), HwaPol-II-1 (*Haloquadratum walsbyi* DSM 16790), HwaPol-II-2 (*Haloquadratum walsbyi* DSM 16790), HwaPolB-1 (*Haloquadratum walsbyi* DSM 16790), HwaPolB-2 (*Haloquadratum walsbyi* DSM 16790), HwaPolB-3 (*Haloquadratum walsbyi* DSM 16790), HwaRCF (*Haloquadratum walsbyi* DSM 16790), HwaRIR1-1 (*Haloquadratum walsbyi* DSM 16790), HwaRIR1-2 (*Haloquadratum walsbyi* DSM 16790), HwaTop6B (*Haloquadratum walsbyi* DSM 16790), rPolA" (*Haloquadratum walsbyi* DSM 16790), MaeoPol-II (*Methanococcus aeolicus* Nankai-3), MaeoRFC (*Methanococcus aeolicus* Nankai-3), MaeoRNR (*Methanococcus aeolicus* Nankai-3), Maeo-N3Helicase (*Methanococcus aeolicus* Nankai-3), UDPGD (*Methanococcus aeolicus* Nankai-3), Maeo-N3RtcB (*Methanococcus aeolicus* Nankai-3), Mein-MEPEP (*Methanocaldococcus infernus* ME), Mein-MERFC (*Methanocaldococcus infernus* ME), MemarMCM2 (*Methanoculleus marisnigri* JR1), Memar-Pol-II (*Methanoculleus marisnigri* JR1), Mesp-FS406PoB-1 (*Methanocaldococcus* sp. FS406-22), Mesp-FS406PolB-2 (*Methanocaldococcus* sp. FS406-22), Mesp-FS406PoB-3 (*Methanocaldococcus* sp. FS406-22), Msp-FS406-22LHR (*Methanocaldococcus* sp. FS406-22), Mfe-AG86Pol-1 (*Methanocaldococcus fervens* AG86), Mfe-AG86Pol-2 (*Methanocaldococcus fervens* AG86), MhuPol-II (*Methanospirillum hungateii* JF-1), MjaGF-6P (*Methanococcus jannaschii*), MjaHelicase (*Methanococcus jannaschii*), Mja-Hyp-1 (*Methanococcus jannaschii*), MjaIF2 (*Methanococcus jannaschii*), MjaKlba (*Methanococcus jannaschii*), Mja-PEP (*Methanococcus jannaschii*), MjaPol-1 (*Methanococcus jannaschii*), MjaPol-2 (*Methanococcus jannaschii*), MjaRFC-1 (*Methanococcus jannaschii*), MjaRFC-2 (*Methanococcus jannaschii*), MjaRFC-3 (*Methanococcus jannaschii*), MjaRNR-1 (*Methanococcus jannaschii*), MjaRNR-2 (*Methanococcus jannaschii*), Mja-Hyp-2 (*Methanococcus jannaschii*), MjaTFIIB (*Methanococcus jannaschii*), UDPGD (*Methanococcus jannaschii*), Mjar-Gyr (*Methanococcus jannaschii*), rPolA' (*Methanococcus jannaschii*), Mja rPol A' (*Methanococcus jannaschii*), MkaCDC48 (*Methanopyrus kandleri* AV19), MkaEF2 (*Methanopyrus kandleri* AV19), MkaRFC (*Methanopyrus kandleri* AV19), MkaRtcB (*Methanopyrus kandleri* AV19), MkaVatB (*Methanopyrus kandleri* AV19), MthRIR1 (*Methanothermobacter thermautotrophicus*), Mvu-M7Helicase (*Methanocaldococcus vulcanius* M7), Mvu-M7Pol-1 (*Methanocaldococcus vulcanius* M7), Mvu-M7Pol-2 (*Methanocaldococcus vulcanius* M7), Mvu-M7Pol-3 (*Methanocaldococcus vulcanius* M7), UDPGD (*Methanocaldococcus vulcanius* M7), NeqPol-c (*Nanoarchaeum equitans* Kin4-M), NeqPol-n (*Nanoarchaeum equitans* Kin4-M), Nma-ATCC43099MCM (*Natrialba magadii* ATCC 43099), Nma-ATCC43099PolB-1 (*Natrialba magadii* ATCC 43099), Nma-ATCC43099PolB-2 (*Natrialba magadii* ATCC 43099), NphCDC21 (*Natronomonas pharaonis* DSM 2160), NphPolB-2 (*Natronomonas pharaonis* DSM 2160), NphPolB-1 (*Natronomonas pharaonis* DSM 2160), rPolA" (*Natronomonas pharaonis* DSM 2160), PabCDC21-1 (*Pyrococcus abyssi*), PabCDC21-2 (*Pyrococcus abyssi*), PabIF2 (*Pyrococcus abyssi*), PabKlbA (*Pyrococcus abyssi*), PabLon (*Pyrococcus abyssi*), PabMoaa (*Pyrococcus abyssi*), PabPol-II (*Pyrococcus abyssi*), PabRFC-1 (*Pyrococcus abyssi*), PabRFC-2 (*Pyrococcus abyssi*), PabRIR1-1 (*Pyrococcus abyssi*), PabRIR1-2 (*Pyrococcus abyssi*), PabRIR1-3 (*Pyrococcus abyssi*), PabHyp-2 (*Pyrococcus abyssi*), PabVMA (*Pyrococcus abyssi*), ParRIR1 (*Pyrobaculum arsenaticum* DSM 13514), PfuCDC21 (*Pyrococcus furiosus*), PfuIF2 (*Pyrococcus furiosus*), PfuKlbA (*Pyrococcus furiosus*), PfuLon (*Pyrococcus furiosus*), PfuRFC (*Pyrococcus furiosus*), PfuRIR1-1 (*Pyrococcus furiosus*), PfuRIR1-2 (*Pyrococcus furiosus*), PfuHyp-2 (*Pyrococcus furiosus*), PfuTopA (*Pyrococcus furiosus*), Pfu-VMA (*Pyrococcus furiosus*), PhoCDC21-1 (*Pyrococcus horikoshii* OT3), PhoCDC21-2 (*Pyrococcus horikoshii* OT3), PhoIF2 (*Pyrococcus horikoshii* OT3), PhoKlbA (*Pyrococcus horikoshii* OT3), PhoLHR (*Pyrococcus horikoshii* OT3), PhoLon (*Pyrococcus horikoshii* OT3), PoII (*Pyrococcus horikoshii* OT3), PhoPol-II (*Pyrococcus horikoshii* OT3), PhoRFC (*Pyrococcus horikoshii* OT3), PhoRIR1 (*Pyrococcus horikoshii* OT3), PhoRadA (*Pyrococcus horikoshii* OT3), PhoVMA (*Pyrococcus horikoshii* OT3), PhoHyp-2 (*Pyrococcus horikoshii* OT3), Phor-Gyr (*Pyrococcus horikoshii* OT3), Psp-GBDPol (*Pyrococcus* species GB-D), Smar1471 (*Staphylothermus marinus* F1), PtoVMA (*Picrophilus torridus* DSM 9790), Tac-ATCC25905VMA (*Thermoplasma acidophilum* ATCC 25905), SmarMCM2 (*Staphylothermus marinus* F1), Tac-DSM1728VMA (*Thermoplasma acidophilum* DSM1728), Tsp-TYPol-1 (*Thermococcus aggregans*), Tsp-TYPol-2 (*Thermococcus aggregans*), Tsp-TYPol-3 (*Thermococcus aggregans*), TbaPol-II (*Thermococcus barophilus* MP), TfuPol-1 (*Thermococcus fumicolans*), ThyPol-1 (*Thermococcus hydrothermalis*), TfuPol-2 (*Thermococcus fumicolans*), ThyPol-2 (*Thermococcus hydrothermalis*), TkoCDC21-1 (*Thermococcus kodakaraensis* KOD1), TkoCDC21-2 (*Thermococcus kodakaraensis* KOD1), TkoHelicase (*Thermococcus kodakaraensis* KOD1), TkoIF2 (*Thermococcus kodakaraensis* KOD1), TkoKlbA (*Thermococcus kodakaraensis* KOD1), TkoLHR (*Thermococcus kodakaraensis* KOD1), Psp-KOD-Pol-1 (*Thermococcus kodakaraensis* KOD1), KODPol-2 (*Thermococcus kodakaraensis* KOD1), TkoPol-II (*Thermococcus kodakaraensis* KOD1), TkoRIR1-1 (*Thermococcus kodakaraensis* KOD1), TkoRFC (*Thermococcus kodakaraensis* KOD1), TkoRIR1-2 (*Thermococcus kodakaraensis* KOD1), TkoRadA (*Thermococcus kodakaraensis* KOD1), TkoTopA (*Thermococcus kodakaraensis* KOD1), Tkor-Gyr (*Thermococcus kodakaraensis* KOD1), TliPol-1 (*Thermococcus litoralis*), TliPol-2 (*Thermococcus litoralis*), TmaPol (*Thermococcus marinus*), Ton-NA1LHR (*Thermococcus onnurineus* NA1), Ton-NA1Pol (*Thermococcus onnurineus* NA1), TpePol (*Thermococcus peptonophilus* strain SM2), Tsi-MM739Lon (*Thermococcus sibiricus* MM 739), Tsi-MM739Pol-1 (*Thermococcus sibiricus* MM 739), Tsi-MM739Pol-2 (*Thermococcus sibiricus* MM 739), Tsi-MM739RFC (*Thermococcus sibiricus* MM 739), AM4RtcB (*Thermococcus* sp. AM4), Tsp-AM4LHR (*Thermococcus* sp. AM4), Tsp-AM4Lon (*Thermococcus* sp. AM4), Tsp-AM4RIR1 (*Thermococcus* sp. AM4), Tsp-GE8Pol-2 (*Thermococcus* species GE8), Tsp-GE8Pol-1 (*Thermococcus* species GE8), Tsp-GTPol-1 (*Thermococcus* species GT), Tsp-GTPol-2 (*Thermococcus* species GT), Tsp-OGL-P20Pol (*Thermococcus* sp. OGL-20P), TthiPol (*Thermococcus thioreducens*), TziPol (*Thermococcus zilligii*), TvoVMA (*Thermoplasma volcanium* GSS1), Unc-ERSPFL (uncultured archaeon GZfos13E1), Unc-ERSRIR1 (uncultured archaeon GZfos9C4), Unc-MetRFSMCM2 (uncultured archaeon Rice Cluster I), Unc-ERSRNR (uncultured archaeon GZfos10C7)

The intein name provides information about the organism and the protein name given to a homolog of the protein that hosts the intein in a well studied organism. For example, in the name Ade-ER3PRP8, "Ade-ER3" refers to the organism *Ajellomyces dermatitidis* ER-3 and PRP8 is the protein name given to a homolog of the protein that hosts the intein in a well studied organism.

Inteins can be developed to splice conditionally and can be used as protease switches in non-native protease hosts to regulate protease activity. A library of intein-modified proteases may be constructed, expressed in a compatible expression host and screened for activity after intein splicing has occurred. This system may allow for broad control of the screening conditions, and through repetitive iterations of mutation and screening, the evolution of desired protease properties. The inteins may be inserted within a protease prior to (on the amino terminal side of) serines, threonines, or cysteines. These amino acids may play a role in facilitating intein splicing and may be common targets for engineering inteins into host target proteases that do not otherwise harbor an intein sequence. Inteins can be inserted into a protease at any position where a serine, threonine, or cysteine occurs in the original (or native) amino acid sequence of the enzyme. By inserting a serine, threonine or cysteine amino acid into the sequence, or by mutating the native protease sequence to change a native amino acid to one of these amino acids at any position in the protease, it may be possible to place an intein at any desired position within the protease sequence.

In an embodiment, the intein may be capable of effecting trans-splicing of the intein-modified protease. The intein may include an N-intein and a C-intein. An amino acid sequence of the N-intein may have at least 70, 72, 75, 80, 85, 90, 91, 92, 93, 94, 95, 96, 97, 98, 99, or 100% identity to a reference sequence selected from SEQ ID NOS: SEQ ID NO: 38 (DnaE-N), SEQ ID NO: 537 (gp41-1-N), SEQ ID NO: 539 (gp41-8-N), SEQ ID NO: 541 (IMPDH-1-N), and SEQ ID NO: 543 (NrdJ-1-N). An amino acid sequence of the C-intein may have at least 90% identity to a reference sequence selected from the group consisting of: SEQ ID NO: 39 (DnaE-C), SEQ ID NO: 538 (gp41-1-C), SEQ ID NO: 540 (gp41-8-C), SEQ ID NO: 542 (IMPDH-1-C), and SEQ ID NO: 544 (NrdJ-1-C).

The intein-modified protease may include a first having an N-extein of the target protease and an N-intein of the intein. The carboxy terminus of the N-extein may be fused with an amino terminus of the N-intein. The first portion may include a sequence with at least 70, 72, 75, 80, 85, 90, 91, 92, 93, 94, 95, 96, 97, 98, 99, or 100% identity to a reference sequence selected form the group consisting of: SEQ ID NO: 13 (Q53521-T108:DnaE-N), SEQ ID NO: 15 (53521-S154:DnaE-N), SEQ ID NO: 17 (Q53521-S234:DnaE-N), SEQ ID NO: 19 (Q53521-S260:DnaE-N), SEQ ID NO: 21 (Q5321-S263-DnaE-N), SEQ ID NO: 23 (Q53521-T317:DnaE-N), SEQ ID NO: 454 (NI-GG-6H), SEQ ID NO: 456 (S135_IMPDH-NI), SEQ ID NO: 457 (S269_IMPDH-NI), SEQ ID NO: 458 (S293_IMPDH-NI), SEQ ID NO: 459 (S317_IMPDH-NI), SEQ ID NO: 460 (T318_IMPDH-NI), SEQ ID NO: 461 (S135_gp41-1-NI), SEQ ID NO: 462 (S269_gp41-1-NI), SEQ ID NO: 463 (S293_gp41-1-NI), SEQ ID NO: 464 (S317_gp41-1-NI), SEQ ID NO: 465 (T318_gp41-1-NI), SEQ ID NO: 466 (S135_gp41-8-NI), SEQ ID NO: 467 (S269_gp41-8-NI), SEQ ID NO: 468 (S293_gp41-8-NI), SEQ ID NO: 469 (S317_gp41-8-NI), SEQ ID NO: 470 (T318_gp41-8-NI), SEQ ID NO: 471 (S135_NrdJ-1-NI), SEQ ID NO: 472 (S269_NrdJ-1-NI), SEQ ID NO: 473 (S293_NrdJ-1-NI), SEQ ID NO: 474 (S317_NrdJ-1-NI), and SEQ ID NO: 475 (T318_NrdJ-1-NI).

In an embodiment, the intein-modified protease may include a second portion having a C-intein of the intein and a C-extein of the target protease. The carboxy terminus of the C-intein may be fused to the amino terminus of the C-extein. The second portion may include a sequence with at least 70, 72, 75, 80, 85, 90, 91, 92, 93, 94, 95, 96, 97, 98, 99, or 100% identity to a reference sequence selected form the group consisting of: SEQ ID NO: 14 (DnaE-C:T108-Q53521-C), SEQ ID NO: 16 (DnaE-C:S154-Q53521-C), SEQ ID NO: 18 (DnaE-C:S234-Q53521-C), SEQ ID NO: 20 (DnaE-C:S260-Q53521-C), SEQ ID NO: 22 (DnaE-C:S263-Q53521-C), SEQ ID NO: 24 (DnaE-C:T317-Q53521-C), SEQ ID NO: 455 (IC-SUMO-6H), SEQ ID NO: 476 (S135_IMPDH-IC), SEQ ID NO: 477 (S269_IMPDH-IC), SEQ ID NO: 478 (S293_IMPDH-IC), SEQ ID NO: 479 (S317_IMPDH-IC), SEQ ID NO: 480 (T318_IMPDH-IC), SEQ ID NO: 481 (S135_gp41-1-IC), SEQ ID NO: 482 (S269_gp41-1-IC), SEQ ID NO: 483 (S293_gp41-1-IC), SEQ ID NO: 484 (S317_gp41-1-IC), SEQ ID NO: 485 (T318_gp41-1-IC), SEQ ID NO: 486 (S135_gp41-8-IC), SEQ ID NO:487 (S269_gp41-8-IC), SEQ ID NO: 488 (S293_gp41-8-IC), SEQ ID NO: 489 (S317_gp41-8-IC), SEQ ID NO: 490 (T318_gp41-8-IC), SEQ ID NO: 491 (S135_NrdJ-1-IC), SEQ ID NO: 492 (S269_NrdJ-1-IC), SEQ ID NO: 493 (S293_NrdJ-1-IC), SEQ ID NO: 494 (S317_NrdJ-1-IC), and SEQ ID NO: 495 (T318_NrdJ-1-IC).

The first and the second portions of the intein-modified protease may be separated prior to splicing. Separation may be achieved by expressing the first and the second portions in different compartments of the host cell. Separation may be achieved by expressing the first and the second portions in different host cells. Separation may be achieved in male and female lines of the same host host. The first portion may be expressed in a male line of a plant species. The second portion may be expressed in a female line of the same plant species. The male and female lines may be crossed during plant breeding to create a line having both the first and the second portions of the intein-modified protease. Contacting the first portion with the second portion may cause trans-splicing of the intein-modified protease.

In an embodiment, the intein may be capable of effecting cis-splicing of the intein-modified protease. A cis-splicing intein may be fused internally to the target protease. An amino acid sequence of the cis-splicing intein may have at least 70, 72, 75, 80, 85, 90, 91, 92, 93, 94, 95, 96, 97, 98, 99, or 100% identity to a reference sequence selected from SEQ ID NO: 37 (VMA), SEQ ID NO: 40 (Tth), SEQ ID NO: 119 (mTth:EU59 intein), SEQ ID NO: 497 (Cth_ATPase_BIL), SEQ ID NO: 498 (Cwa_RIR1), SEQ ID NO: 499 (Dhan_GLT1), SEQ ID NO: 500 (Fsp-CcI3_RIR1), SEQ ID NO: 501 (Gob_Hyp), SEQ ID NO: 502 (Gvi_RIR1-1), SEQ ID NO: 503 (Hhal_DnaB-1), SEQ ID NO: 504 (Hma_CDC21), SEQ ID NO: 505 (Hwa_MCM-1), SEQ ID NO: 506 (Hwa_PolB-2), SEQ ID NO: 507 (Hwa_RIR1-1), SEQ ID NO: 508 (Hwa_RIR1-2), SEQ ID NO: 509 (Hwa_r-Pol_App), SEQ ID NO: 510 (Kra_DnaB), SEQ ID NO: 511 (Mca_RIR1), SEQ ID NO: 512 (Memar_Pol-II), SEQ ID NO: 513 (Mex_helicase), SEQ ID NO: 514 (Mhu_Pol-II), SEQ ID NO: 515 (Mja_Klba), SEQ ID NO: 516 (Mja_PEP), SEQ ID NO: 517 (Mja_Pol-2), SEQ ID NO: 518 (Mja_RFC-3), SEQ ID NO: 519 (Mja_r-Gyr), SEQ ID NO: 520 (MP-Be_gp51), SEQ ID NO: 521 (Nsp-PCC7120_RIR1), SEQ ID NO: 522 (Pab_RIR1-3), SEQ ID NO: 523 (Pfu_KlbA), SEQ ID NO: 524 (Pho_IF2), SEQ ID NO: 525 (Pho_r-Gyr), SEQ ID NO: 526 (Pno_RPA2), SEQ ID NO: 527 (SaP-SETP3_Helicase), SEQ ID NO: 528 (StP-Twort_ORF6), SEQ ID NO: 529 (Ter_DnaE-2), SEQ ID NO: 530 (Ter_RIR1-3), SEQ ID NO: 531 (Tko_Helicase), SEQ ID NO: 532 (Tko_Pol-2_Pko_Pol-2), SEQ ID NO: 533 (Tvo_VMA), SEQ ID NO: 534 (Tvu_DnaE-n_NC-terminal), SEQ ID NO: 535 (Unc-ERS_RIR1), SEQ ID NO: 536 (Synthetic construct Unc-ERS_RIR1_var7), SEQ ID NO: 684 (mVMA:P77Cd), and SEQ ID NO: 685 (mTth:P77Cd).

In an embodiment, the intein-modified protease may comprise, consist essentially of, or consist of an amino acid sequence with at least 70, 72, 75, 80, 85, 90, 91, 92, 93, 94, 95, 96, 97, 98, 99, or 100% identity to a reference sequence selected from the group consisting of: SEQ ID NO: 25 (Savinase-S114:VMA), SEQ ID NO: 26 (Savinase-T148:VMA), SEQ ID NO: 27 (Savinase-S166:VMA), SEQ ID NO: 28 (Savinase-S253:VMA), SEQ ID NO: 29 (Savinase-S269:VMA), SEQ ID NO: 30 (Savinase-S347:VMA), SEQ ID NO: 31 (Savinase-S114:Tth), SEQ ID NO: 32 (Savinase-T148:Tth), SEQ ID NO: 33 (Savinase-S166:Tth), SEQ ID NO: 34 (Savinase-S253:Tth). SEQ ID NO: 35 (Savinase-S269:Tth), SEQ ID NO: 36 (Savinase-S347:Tth), SEQ ID NO: 120 (ProSavinase S46-mTth:EU59), SEQ ID NO: 121 (ProSavinase S62-mTth:EU59), SEQ ID NO:122 (ProSavinase T77-mTth:EU59), SEQ ID NO:123 (ProSavinase S86-mTth:EU59), SEQ ID NO:124 (ProSavinase S100-mTth:EU59), SEQ ID NO:125 ProSavinase T109-mTth:EU59, SEQ ID NO:126 (ProSavinase S135-mTth:EU59), SEQ ID NO:127 (ProSavinase T148-mTth:EU59), SEQ ID NO:SEQ ID NO:128 (ProSavinase S166-mTth:EU59), SEQ ID NO:129 (ProSavinase T167-mTth:EU59), SEQ ID NO:130 (ProSavinase S196-mTth:EU59), SEQ ID NO:131 (ProSavinase S208-mTth:EU59), SEQ ID NO:132 (ProSavinase S239-mTth:EU59), SEQ ID NO:133 (ProSavinase T243-mTth:EU59), SEQ ID NO: 134 (ProSavinase S269-mTth:EU59), SEQ ID NO: 135 (ProSavinase T285-mTth:EU59), SEQ ID NO:136 (ProSavinase S293-mTth:EU59), SEQ ID NO: 137 (ProSavinase S317-mTth:EU59), SEQ ID NO: 138 (ProSavinase T318-mTth:EU59), SEQ ID NO: 139 (ProSavinase T329-mTth:EU59), SEQ ID NO: 140 (ProSavinase_S135: 1: Aae_RIR2), SEQ ID NO: 141 (ProSavinase_S135: 2: Ace_RIR1), SEQ ID NO:SEQ ID NO: 142 (ProSavinase_S135: 3: Aeh_DnaB-2), SEQ ID NO: 143 (ProSavinase_S135: 4: Ani-FGSCA4_PRP8), SEQ ID NO: 144 (ProSavinase_S135: 5: Ape_APE0745), SEQ ID NO: 145 (ProSavinase_S135: 6: Avin_RIR1_BIL), SEQ ID NO: 146 (ProSavinase_S135: 7: Bde-JEL197_RPB2), SEQ ID NO: 147 (ProSavinase_S135: 8: Bde-JEL423_eIF-5), SEQ ID NO: 148 (ProSavinase_S135: 9: BsuP-M1918_RIR1), SEQ ID NO: 149 (ProSavinase_S135: 10: CagRIR1), SEQ ID NO: 150 (ProSavinase_S135: 11: Cau_SpoVR), SEQ ID NO: 151 (ProSavinase_S135: 12: Cbu_DnaB), SEQ ID NO: 152 (ProSavinase_S135: 13: Ceu_ClpP), SEQ ID NO: 153 (ProSavinase_S135: 14: Chy_RIR1), SEQ ID NO: 154 (ProSavinase_S135: 15: Cth_ATPase_BIL), SEQ ID NO: 155 (ProSavinase_S135: 16: Cth_TerA), SEQ ID NO: 156 (ProSavinase_S135: 17: CV-NY2A_RIR1), SEQ ID NO: 157 (ProSavinase_S135: 18: Cwa_PEP), SEQ ID NO: 158 (ProSavinase_S135: 19: Cwa_RIR1), SEQ ID NO: 159 (ProSavinase_S135: 20: Dhan_GLT1), SEQ ID NO: 160 (ProSavinase_S135: 21: Fsp-CcI3_RIR1), SEQ ID NO: 161 (ProSavinase_S135: 22: Gob_DnaE), SEQ ID NO: 162 (ProSavinase_S135: 23: Gob_Hyp), SEQ ID NO: 163 (ProSavinase_S135: 24: Gvi_RIR1-1), SEQ ID NO: 164 (ProSavinase_S135: 25: Hhal_DnaB-1), SEQ ID NO: 165 (ProSavinase_S135: 26: Hma_CDC21), SEQ ID NO: 166 (ProSavinase_S135: 27: Hma_TopA), SEQ ID NO: 167 (ProSavinase_S135: 28: Hsa-NRC1_CDC21), SEQ ID NO: 168 (ProSavinase_S135: 29: Hvo_PolB), SEQ ID NO:169 (ProSavinase_S135: 30: Hwa_GyrB), SEQ ID NO:170 (ProSavinase_S135: 31: Hwa_MCM-1), SEQ ID NO: 171 (ProSavinase_S135: 32: Hwa_MCM-4), SEQ ID NO: 172 (ProSavinase_S135: 33: Hwa_PolB-2), SEQ ID NO: 173 (ProSavinase_S135: 34: Hwa_Pol-II-1), SEQ ID NO: 174 (ProSavinase_S135: 35: Hwa_Pol-II-2), SEQ ID NO: 175 (ProSavinase_S135: 36: Hwa_RIR1-1), SEQ ID NO:176 (ProSavinase_S135: 37: Hwa_RIR1-2), SEQ ID NO: 177 (ProSavinase_S135: 38: Hwa_rPol_App), SEQ ID NO: 178 (ProSavinase_S135: 39: Kra_DnaB), SEQ ID NO: 179 (ProSavinase_S135: 40: Mca_RIR1), SEQ ID NO:180 (ProSavinase_S135: 41; Memar_Pol-II), SEQ ID NO: 181 (ProSavinase_S135: 42: Mex_helicase), SEQ ID NO:182 (ProSavinase_S135: 43: Mhu_Pol-II), SEQ ID NO: 183 (ProSavinase_S135: 44: Mja_GF-6P), SEQ ID NO: 184 (ProSavinase_S135: 45: Mja_Helicase), SEQ ID NO:185 (ProSavinase_S135: 46; Mja_Hyp-1), SEQ ID NO:186 (ProSavinase_S135: 47: Mja_IF2), SEQ ID NO:187 (ProSavinase_S135: 48; Mja_Klba), SEQ ID NO:188 (ProSavinase_S135: 49: Mja_PEP), SEQ ID NO:189 (ProSavinase_S135: 50: Mja_Pol-1), SEQ ID NO:190 (ProSavinase_S135: 51: Mja_Pol-2), SEQ ID NO: 191 (ProSavinase_S135: 52: Mja_RFC-1), SEQ ID NO: 192 (ProSavinase_S135: 53; Mja_RFC-2), SEQ ID NO: 193 (ProSavinase_S135: 54: Mja_RFC-3), SEQ ID NO: 194 (ProSavinase_S135: 55: Mja_r-Gyr), SEQ ID NO:195 (ProSavinase_S135: 56: Mja_RNR-1), SEQ ID NO: 196 (ProSavinase_S135: 57: Mja_RNR-2), SEQ ID NO:197 (ProSavinase_S135: 58: Mja_rPol_Ap), SEQ ID NO: 198 (ProSavinase_S135: 59: Mja_rPol_App), SEQ ID NO: 199 (ProSavinase_S135: 60: Mja_RtcB_Mja_Hyp-2), SEQ ID NO: 200 (ProSavinase_S135: 61: Mja_TFIIB), SEQ ID NO: 201 (ProSavinase_S135: 62: Mja_UDP_GD), SEQ ID NO: 202 (ProSavinase_S135: 63: Mka_CDC48), SEQ ID NO: 203 (ProSavinase_S135: 64: Mka_EF2), SEQ ID NO: 204 (ProSavinase_S135: 65: Mka_RFC), SEQ ID NO: 205 (Pro- Savinase_S135: 66: Mka_RtcB), SEQ ID NO: 206 (ProSavinase_S135: 67: Mka_VatB), SEQ ID NO: 207 (ProSavinase_S135: 68: MP-Be_gp51), SEQ ID NO: 208 (ProSavinase_S135: 69; MP-Catera_gp206), SEQ ID NO: 209 (ProSavinase_S135: 70: Mxa_RAD25), SEQ ID NO: 210 (ProSavinase_S135: 71: Nfa_DnaB), SEQ ID NO: 211 (ProSavinase_S135: 72: Nfa_Nfa15250), SEQ ID NO: 212 (ProSavinase_S135: 73: Nfa_RIR1), SEQ ID NO:213 (ProSavinase_S135: 74: Nph_CDC21), SEQ ID NO: 214 (ProSavinase_S135: 75: Nph_rPol_App), SEQ ID NO: 215 (ProSavinase_S135: 76: Npu_GyrB), SEQ ID NO: 216 (ProSavinase_S135: 77: Nsp-JS614_DnaB), SEQ ID NO: 217 (ProSavinase_S135: 78: Nsp-PCC7120_RIR1), SEQ ID NO: 218 (ProSavinase_S135: 79: Pab_CDC21-1), SEQ ID NO: 219 (ProSavinase_S135: 80: Pab_CDC21-2), SEQ ID NO: 220 (ProSavinase_S135: 81: Pab_IF2), SEQ ID NO: 221 (ProSavinase_S135: 82: Pab_KbA), SEQ ID NO: 222 (ProSavinase_S135: 83: Pab_Lon), SEQ ID NO: 223 (ProSavinase_S135: 84: Pab_Moaa), SEQ ID NO: 224 (ProSavinase_S135: 85: Pab_Pol-II), SEQ ID NO: 225 (ProSavinase_S135: 86: Pab_RFC-1), SEQ ID NO: 226 (ProSavinase_S135: 87: Pab_RFC-2), SEQ ID NO: 227 (ProSavinase_S135: 88: Pab_RIR1-1), SEQ ID NO: 228 (ProSavinase_S135: 89: Pab_RIR1-2), SEQ ID NO: 229 (ProSavinase_S135: 90: Pab_RIR1-3), SEQ ID NO: 230 (ProSavinase_S135: 91: Pab_RtcB_Pab_Hyp-2), SEQ ID NO: 231 (ProSavinase_S135: 92: Pab_VMA), SEQ ID NO: 232 (ProSavinase_S135: 93: Pan_CHS2), SEQ ID NO: 233 (ProSavinase_S135: 94: Pbr_PRP8), SEQ ID NO: 234 (ProSavinase_S135: 95: Pch_PRP8), SEQ ID NO: 235 (ProSavinase_S135: 96: Pfu_CDC21), SEQ ID NO: 236 (ProSavinase_S135: 97: Pfu_IF2), SEQ ID NO: 237 (ProSavinase_S135: 98; Pfu_KlbA), SEQ ID NO: 238 (ProSavinase_S135: 99: Pfu_Lon), SEQ ID NO: 239 (ProSavinase_S135: 100: Pfu_RFC), SEQ ID NO: 240 (ProSavinase_S135: 101: Pfu_TopA), SEQ ID NO: 241 (ProSavinase_S135: 102: Pho_CDC21-2), SEQ ID NO: 242 (ProSavinase_S135: 103: Pho_IF2), SEQ ID NO: 243 (ProSavinase_S135: 104: Pho_LHR), SEQ ID NO: 244 (ProSavinase_S135: 105: Pho_Lon), SEQ ID NO: 245 (ProSavinase_S135: 106: Pho_Pol_I), SEQ ID NO: 246 (ProSavinase_S135: 107: Pho_RadA), SEQ ID NO: 247 (ProSavinase_S135: 108: Pho_r-Gyr), SEQ ID NO: 248 (ProSavinase_S135: 109: Pho_RtcB_Pho_Hyp-2), SEQ ID NO: 249 (ProSavinase_S135: 110: Pho_VMA), SEQ ID NO: 250 (ProSavinase_S135: 111: Pna_RIR1), SEQ ID NO: 251 (ProSavinase_S135: 112: Pno_RPA2), SEQ ID NO: 252 (ProSavinase_S135: 113: Posp-JS666_RIR1), SEQ ID NO: 253 (ProSavinase_S135: 114: PP-PhiEL_ORF39), SEQ ID NO: 254 (ProSavinase_S135: 115: Pst_VMA), SEQ ID NO: 255 (ProSavinase_S135: 116: Rma_DnaB), SEQ ID NO: 256 (ProSavinase_S135: 117: Rsp_Rir1), SEQ ID NO: 257 (ProSavinase_S135: 118: SaP-SETP3_Helicase), SEQ ID NO: 258 (ProSavinase_S135: 119: Sav_Helicase), SEQ ID NO: 259 (ProSavinase_S135: 120: Sex-IFO1128_VMA), SEQ ID NO: 260 (ProSavinase_S135: 121: Smar_1471), SEQ ID NO: 261 (ProSavinase_S135: 122: Smar_MCM2), SEQ ID NO: 262 (ProSavinase_S135: 123: Sru_DnaB), SEQ ID NO: 263 (ProSavinase_S135: 124: Sru_PolBc), SEQ ID NO: 264 (ProSavinase_S135: 125: Ssp_DnaB), SEQ ID NO: 265 (ProSavinase_S135: 126: Ssp_GyrB), SEQ ID NO: 266 (ProSavinase_S135: 127: StP-Twort_ORF6), SEQ ID NO: 267 (ProSavinase_S135: 128: TagPol-1_Tsp-TY_Pol-1), SEQ ID NO: 268 (ProSavinase_S135: 129: TagPol-2_Tsp-TY_Pol-2_T134), SEQ ID NO: 269 (ProSavinase_S135: 130: Ter_DnaB-1Ter_DnaB-1), SEQ ID NO: 270 (ProSavinase_S135: 131: Ter_DnaE-2), SEQ ID NO: 271 (ProSavinase_S135: 132: Ter_DnaE-3nc_NC-terminal), SEQ ID NO: 272 (ProSavinase_S135: 133: Ter_Ndse-2), SEQ ID NO: 273 (ProSavinase_S135: 134: Ter_RIR1-3Ter_RIR1-3), SEQ ID NO: 274 (ProSavinase_S135: 135: Ter_RIR1-4), SEQ ID NO: 275 (ProSavinase_S135: 136: Ter_Snf2), SEQ ID NO: 276 (ProSavinase_S135: 137: Tfu_Pol-2), SEQ ID NO: 277 (ProSavinase_S135:138: Tfus_RecA-1), SEQ ID NO: 278 (ProSavinase_S135: 139: Tfus_RecA-2), SEQ ID NO: 279 (ProSavinase_S135: 140: Thy_Pol-1), SEQ ID NO: 280 (ProSavinase_S135: 141: Tko_CDC21-2), SEQ ID NO: 281 (ProSavinase_S135: 142: Tko_Helicase), SEQ ID NO: 282 (ProSavinase_S135: 143: Tko_IF2), SEQ ID NO: 283 (ProSavinase_S135: 144: Tko_LHR), SEQ ID NO: 284 (ProSavinase_S135: 145: Tko_Pol-2_Pko_Pol-2), SEQ ID NO: 285 (ProSavinase_S135: 146: Tko_RadA), SEQ ID NO: 286 (ProSavinase_S135: 147: Tko_r-Gyr), SEQ ID NO: 287 (ProSavinase_S135: 148: Tko_RIR1-1), SEQ ID NO: 288 (ProSavinase_S135: 149: Tko_TopA), SEQ ID NO: 289 (ProSavinase_S135: 150: Tth-HB27_DnaE-2), SEQ ID NO: 290 (ProSavinase_S135: 151: Tth-HB27_RIR1-1), SEQ ID NO: 291 (ProSavinase_S135: 152: Tth-HB27_RIR1-2), SEQ ID NO: 292 (ProSavinase_S135: 153: Tvo_VMA), SEQ ID NO: 293 (ProSavinase_S135: 154: Tvu_DnaEn_NC-terminal), SEQ ID NO: 294 (ProSavinase_S135:155: Unc-ERS_RIR1), SEQ ID NO: 295 (ProSavinase_S135: 156: Zba_VMA), SEQ ID NO: 296 (ProSavinase_S135:157: Zro_VMAZro_VMA), SEQ ID NO: 297 (ProSavinase_S317: 1: Aae_RIR2), SEQ ID NO: 298 (ProSavinase_S317: 2: Ace_RIR1), SEQ ID NO: 299 (ProSavinase_S317: 3: Aeh_DnaB-2), SEQ ID NO: 300 (ProSavinase_S317: 4: Ani-FGSCA4_PRP8), SEQ ID NO: 301 (ProSavinase_S317: 5: Ape_APE0745), SEQ ID NO: 302 (ProSavinase_S317: 6: Avin_RIR1_BIL), SEQ ID NO: 303 (ProSavinase_S317: 7: Bde-JEL197_RPB2), SEQ ID NO: 304 (ProSavinase_S317: 8: Bde-JEL423_eIF-5B), SEQ ID NO: 305 (ProSavinase_S317: 9: BsuP-M1918_RIR1), SEQ ID NO: 306 (ProSavinase_S317: 10: CagRIR1), SEQ ID NO: 307 (ProSavinase_S317: 11: Cau_SpoVR), SEQ ID NO: 308 (ProSavinase_S317: 12: Cbu_DnaB), SEQ ID NO: 309 (ProSavinase_S317: 13: Ceu_ClpP), SEQ ID NO:310 (ProSavinase_S317: 14: Chy_RIR1), SEQ ID NO: 311 (ProSavinase_S317: 15: Cth_ATPase_BIL), SEQ ID NO: 312 (ProSavinase_S317: 16: Cth_TerA), SEQ ID NO: 313 (ProSavinase_S317: 17: CV-NY2A_RIR1), SEQ ID NO: 314 (ProSavinase_S317: 18: Cwa_PEP), SEQ ID NO: 315 (ProSavinase_S317: 19: Cwa_RIR1), SEQ ID NO: 316 (ProSavinase_S317: 20: Dhan_GLT1), SEQ ID NO: 317 (ProSavinase_S317: 21: Fsp-CcI3_RIR1), SEQ ID NO: 318 (ProSavinase_S317: 22: Gob_DnaE), SEQ ID NO: 319 (ProSavinase_S317: 23: Gob_Hyp), SEQ ID NO: 320 (ProSavinase_S317: 24: Gvi_RIR1-1), SEQ ID NO: 321 (ProSavinase_S317:25: Hhal_DnaB-1), SEQ ID NO: 322 (ProSavinase: S317: 26: Hma_CDC21), SEQ ID NO: 323 (ProSavinase_S317: 27: Hma_TopA), SEQ ID NO: 324 (ProSavinase_S317: 28: Hsa-NRC1_CDC21), SEQ ID NO: 325 (ProSavinase_S317: 29: Hvo_PolB), SEQ ID NO: 326 (ProSavinase_S317: 30: Hwa_GyrB), SEQ ID NO: 327 (ProSavinase_S317: 31: Hwa_MCM-1), SEQ ID NO: 328 (ProSavinase_S317: 32: Hwa_MCM-4), SEQ ID NO: 329 (ProSavinase_S317: 33: Hwa_PolB-2), SEQ ID NO: 330 (ProSavinase_S317: 34: Hwa_Pol-II-1), SEQ ID NO: 331 (ProSavinase_S317: 35: Hwa_Pol-II-2), SEQ ID NO: 332 (ProSavinase_S317: 36: Hwa_RIR1-1), SEQ ID NO: 333 (ProSavinase_S317: 37: Hwa_RIR1-2), SEQ ID NO: 334 (ProSavinase_S317: 38: Hwa_rPol_App), SEQ ID NO: 335 (ProSavinase_S317: 39: Kra_DnaB), SEQ ID NO: 336

(ProSavinase_S317: 40: Mca_RIR1), SEQ ID NO: 337 (ProSavinase_S317: 41: Memar_Pol-II), SEQ ID NO: 338 (ProSavinase_S317: 42: Mex_helicase), SEQ ID NO: 339 (ProSavinase_S317: 43: Mhu_Pol-II), SEQ ID NO: 340 (ProSavinase_S317: 44: Mja_GF-6P), SEQ ID NO: 341 (ProSavinase_S317: 45: Mja_Helicase), SEQ ID NO: 342 (ProSavinase_S317: 46: Mja_Hyp-1), SEQ ID NO: 343 (ProSavinase_S317: 47: Mja_IF2), SEQ ID NO: 344 (ProSavinase_S317: 48: Mja_Klba), SEQ ID NO: 345 (ProSavinase_S317: 49: Mja_PEP), SEQ ID NO: 346 (ProSavinase_S317: 50: Mja_Pol-1), SEQ ID NO: 347 (ProSavinase_S317: 51: Mja_Pol-2), SEQ ID NO: 348 (ProSavinase_S317:52: Mja_RFC-1), SEQ ID NO: 349 (ProSavinase_S317: 53: Mja_RFC-2), SEQ ID NO: 350 (ProSavinase: S317: 54: Mja_RFC-3), SEQ ID NO: 351 (ProSavinase_S317: 55: Mja_r-Gyr), SEQ ID NO: 352 (ProSavinase_S317:56: Mja_RNR-1), SEQ ID NO: 353 (ProSavinase_S317: 57: Mja_RNR-2), SEQ ID NO: 354 (ProSavinase_S317:58: Mja_rPol_Ap), SEQ ID NO: 355 (ProSavinase_S317:59: Mja_rPol_App), SEQ ID NO: 356 (ProSavinase_S317: 60: Mja_RtcB_Mja_Hyp-2), SEQ ID NO: 357 (ProSavinase_S317: 61: Mja_TFIIB), SEQ ID NO: 358 (ProSavinase_S317: 62: Mja_UDP_GD), SEQ ID NO: 359 (ProSavinase_S317: 63: Mka_CDC48), SEQ ID NO: 360 (ProSavinase_S317: 64: Mka_EF2), SEQ ID NO: 361 (ProSavinase_S317: 65: Mka_RFC), SEQ ID NO: 362 (ProSavinase_S317: 66; Mka_RtcB), SEQ ID NO: 363 (ProSavinase_S317: 67: Mka_VatB), SEQ ID NO: 364 (ProSavinase_S317: 68: MP-Be_gp51), SEQ ID NO: 365 (ProSavinase_S317: 69: MP-Catera_gp206), SEQ ID NO: 366 (ProSavinase_S317: 70: Mxa_RAD25), SEQ ID NO: 367 (ProSavinase_S317: 71: Nfa_DnaB), SEQ ID NO: 368 (ProSavinase_S317: 72: Nfa_Nfa15250), SEQ ID NO: 369 (ProSavinase_S317: 73: Nfa_RIR1), SEQ ID NO: 370 (ProSavinase_S317: 74: Nph_CDC21), SEQ ID NO: 371 (ProSavinase_S317:75: Nph_rPol_App), SEQ ID NO: 372 (ProSavinase_S317:76: Npu_GyrB), SEQ ID NO: 373 (ProSavinase_S317: 77: Nsp-JS614_DnaB), SEQ ID NO: 374 (ProSavinase_S317: 78: Nsp-PCC7120_RIR1), SEQ ID NO: 375 (ProSavinase_S317: 79: Pab_CDC21-1), SEQ ID NO: 376 (ProSavinase_S317: 80: Pab_CDC21-2), SEQ ID NO: 377 (ProSavinase_S317: 81: Pab_IF2), SEQ ID NO: 378 (ProSavinase_S317: 82: Pab_KbA), SEQ ID NO: 379 (ProSavinase_S317: 83: Pab_Lon), SEQ ID NO: 380 (ProSavinase_S317:84: Pab_Moaa), SEQ ID NO: 381 (ProSavinase_S317: 85: Pab_Pol-II), SEQ ID NO: 382 (ProSavinase_S317: 86: Pab_RFC-1), SEQ ID NO:S 383 (ProSavinase_S317: 87: Pab_RFC-2), SEQ ID NO: 384 (ProSavinase_S317: 88: Pab_RIR1-1), SEQ ID NO: 385 (ProSavinase_S317: 89: Pab_RIR1-2), SEQ ID NO: 386 (ProSavinase_S317: 90: Pab_RIR1-3), SEQ ID NO: 387 (ProSavinase_S317: 91: Pab_RtcB_Pab_Hyp-2), SEQ ID NO: 388 (ProSavinase_S317: 92: Pab_VMA), SEQ ID NO: 389 (ProSavinase_S317: 93: Pan_CHS2), SEQ ID NO: 390 (ProSavinase_S317: 94: Pbr_PRP8), SEQ ID NO: 391 (ProSavinase_S317: 95: Pch_PRP8), SEQ ID NO: 392 (ProSavinase_S317: 96: Pfu_CDC21), SEQ ID NO:393 (ProSavinase_S317: 97: Pfu_IF2), SEQ ID NO: 394 (ProSavinase_S317: 98: Pfu_KlbA), SEQ ID NO: 395 (ProSavinase_S317: 99: Pfu_Lon), SEQ ID NO: 396 (ProSavinase_S317:100: Pfu_RFC), SEQ ID NO: 397 (ProSavinase_S317:101: Pfu_TopA), SEQ ID NO: 398 (ProSavinase_S317: 102: Pho_CDC21-2), SEQ ID NO: 399 (ProSavinase_S317: 103: Pho_IF2), SEQ ID NO: 400 (ProSavinase_S317:104: Pho_LHRPho_LHR), SEQ ID NO: 401 (ProSavinase_S317: 105: Pho_Lon), SEQ ID NO: 402 (ProSavinase_S317:106: Pho_Pol_I), SEQ ID NO: 403 (ProSavinase_S317: 107: Pho_RadA), SEQ ID NO: 404 (ProSavinase_S317: 108: Pho_r-Gyr), SEQ ID NO: 405 (ProSavinase_S317:109: Pho_RtcB_Pho_Hyp-2), SEQ ID NO: 406 (ProSavinase_S317:110: Pho_VMA), SEQ ID NO: 407 (ProSavinase_S317:111: Pna_RIR1), SEQ ID NO: 408 (ProSavinase_S317:112: Pno_RPA2), SEQ ID NO: 409 (ProSavinase_S317: 113: Posp-JS666_RIR1), SEQ ID NO: 410 (ProSavinase_S317: 114: PP-PhiEL_ORF39), SEQ ID NO: 411 (ProSavinase_S317: 115: Pst_VMA), SEQ ID NO: 412 (ProSavinase_S317:116: Rma_DnaB), SEQ ID NO: 413 (ProSavinase_S317: 117: Rsp_Rir1), SEQ ID NO: 414 (ProSavinase_S317: 118: SaP-SETP3_Helicase), SEQ ID NO: 415 (ProSavinase_S317: 119: Sav_Helicase), SEQ ID NO: 416 (ProSavinase_S317: 120: Sex-IFO1128_VMA), SEQ ID NO: 417 (ProSavinase_S317: 121: Smar_1471), SEQ ID NO: 418 (ProSavinase_S317: 122: Smar_MCM2), SEQ ID NO: 419 (ProSavinase_S317: 123: Sru_DnaB), SEQ ID NO:420 (ProSavinase_S317: 124: Sru_PolBc), SEQ ID NO:421 (ProSavinase_S317:125: Ssp_DnaB), SEQ ID NO: 422 (ProSavinase_S317:126: Ssp_GyrB), SEQ ID NO: 423 (ProSavinase_S317:127: StP-Twort_ORF6), SEQ ID NO: 424 (ProSavinase_S317:128: TagPol-1_Tsp-TY_Pol-1), SEQ ID NO: 425 (ProSavinase_S317: 129: TagPol-2_Tsp-TY_Pol-2_T134), SEQ ID NO: 426 (ProSavinase_S317:130: Ter_DnaB-1), SEQ ID NO: 427 (ProSavinase_S317: 131: Ter_DnaE-2), SEQ ID NO:428 (ProSavinase_S317: 132: Ter_DnaE-3nc_NC-terminal), SEQ ID NO: 429 (ProSavinase_S317: 133: Ter_Ndse-2), SEQ ID NO: 430 (ProSavinase_S317: 134: Ter_RIR1-3), SEQ ID NO: 431 (ProSavinase_S317: 135: Ter_RIR1-4), SEQ ID NO: 432 (ProSavinase_S317: 136: Ter_Snf2), SEQ ID NO: 433 (ProSavinase_S317: 137: Tfu_Pol-2), SEQ ID NO: 434 (ProSavinase_S317: 138: Tfus_RecA-1), SEQ ID NO: 435 (ProSavinase_S317: 139: Tfus_RecA-2), SEQ ID NO: 436 (ProSavinase_S317: 140: Thy_Pol-1), SEQ ID NO: 437 (ProSavinase_S317: 141: Tko_CDC21-2), SEQ ID NO: 438 (ProSavinase_S317: 142: Tko_Helicase), SEQ ID NO: 439 (ProSavinase_S317: 143: Tko_IF2), SEQ ID NO: 440 (ProSavinase_S317: 144: Tko_LHR), SEQ ID NO: 441 (ProSavinase_S317: 145: Tko_Pol-2_Pko_Pol-2), SEQ ID NO: 442 (ProSavinase_S317: 146: Tko_RadA), SEQ ID NO: 443 (ProSavinase_S317: 147: Tko_r-Gyr), SEQ ID NO: 444 (ProSavinase_S317: 148: Tko_RIR1-1), SEQ ID NO: 445 (ProSavinase_S317: 149: Tko_TopA), SEQ ID NO: 446 (ProSavinase_S317: 150: Tth-HB27_DnaE-2), SEQ ID NO: 447 (ProSavinase_S317: 151: Tth-HB27_RIR1-1), SEQ ID NO: 448 (ProSavinase_S317: 152 Tth-HB27_RIR1-2), SEQ ID NO: 449 (ProSavinase_S317: 153: Tvo_VMA), SEQ ID NO: 450 (ProSavinase_S317: 154: Tvu_DnaE-n_NC-terminal), SEQ ID NO: 451 (ProSavinase_S317: 155: Unc-ERS_RIR1), SEQ ID NO: 452 (ProSavinase_S317: 156: Zba_VMA), SEQ ID NO: 453 (ProSavinase_S317: 157: Zro_VMA), SEQ ID NO: 496 (ProSavinase_S317: 155_var7), SEQ ID NO: 686 (iproSavS135:mVMA:P77Cd), SEQ ID NO: 687 (iproSavS265:mVMA:P77Cd), SEQ ID NO: 688 (iproSavS269:mVMA:P77Cd), SEQ ID NO: 689 (iproSavS293:mVMA:P77Cd), SEQ ID NO: 690 (iproSavS312:mVMA:P77Cd), SEQ ID NO: 691 (iproSavS317:mVMA:P77Cd), SEQ ID NO: 692 (iproSavS326:mVMA:P77Cd), SEQ ID NO: 693 (iproSavS135:mTth:P77Cd), SEQ ID NO: 694 (iproSavS269:mTth:P77Cd), SEQ ID NO: 695(iproSavS293:mTth:P77Cd), and SEQ ID NO: 696 (iproSavS317:mTth:P77Cd).

Intein may spontaneously splice the intein-modified protease. The intein may be inducible to cause cis-splicing of the intein-modified protease by exposure to an induction condition described herein.

An embodiment includes an expression cassette. The expression cassette may include a polynucleotide encoding an intein-modified protease. The intein-modified protease may be any one described herein.

In an embodiment, the polynucleotide may include a sequence encoding any target protease. The polynucleotide may include a sequence encoding a keratinase. The polynucleotide may include a sequence encoding a Savinase. The polynucleotide may include a sequence with at least 70, 72, 75, 80, 85, 90, 91, 92, 93, 94, 95, 96, 97, 98, 99, or 100% identity to a reference sequence of SEQ ID NO: 41 (Q53521) or SEQ ID NO: 59 (P29600).

In an embodiment, the polynucleotide may include a sequence encoding an intein capable of effecting trans-splicing of the intein-modified protease. The polynucleotide may include a sequence encoding an N-intein or a C-intein. The polynucleotide may include a sequence with at least 70, 72, 75, 80, 85, 90, 91, 92, 93, 94, 95, 96, 97, 98, 99, or 100% identity to a reference sequence selected from the group consisting of: SEQ ID NO: 42 (DnaE-N), SEQ ID NO: 43 (DnaE-C), SEQ ID NO: 674 (gp41-1-N), SEQ ID NO: 675 (gp41-1-C), SEQ ID NO: 676 (gp41-8-N), SEQ ID NO: 677 (gp41-8-C), SEQ ID NO: 678 (IMPDH-1-N), SEQ ID NO: 679 (IMPDH-1-C), SEQ ID NO: 680 (NrdJ-1-C), and SEQ ID NO: 681 (NrdJ-1-N).

In an embodiment, the polynucleotide may include a sequence encoding a first portion of the intein-modified protease. The first portion may include an N-extein of the target protease and an N-intein of the intein. The carboxy terminus of the N-extein may be fused to the amino terminus of the N-intein. The polynucleotide may include the sequence with at least 70, 72, 75, 80, 85, 90, 91, 92, 93, 94, 95, 96, 97, 98, 99, or 100% identity to a reference sequence selected from the group consisting of: SEQ ID NO: 93 (Q53521-T108:DnaE-N), SEQ ID NO: 95 (53521-S154: DnaE-N), SEQ ID NO: 97 (Q53521-S234:DnaE-N), SEQ ID NO: 99 (Q53521-S260:DnaE-N), SEQ ID NO:101 (Q5321-S263-DnaE-N), SEQ ID NO:103 (Q53521-T317: DnaE-N), SEQ ID NO: 587 (NI-GG-6H), SEQ ID NO: 589 (S135_IMPDH-NI), SEQ ID NO: 590 (S269_IMPDH-NI), SEQ ID NO: 591 (S293_IMPDH-NI), SEQ ID NO: 592 (S317_IMPDH-NI), SEQ ID NO: 593 (T318_IMPDH-NI), SEQ ID NO: 594 (S135_gp41-1-NI), SEQ ID NO: 595 (S269_gp41-1-NI), SEQ ID NO: 596 (S293_gp41-1-NI), SEQ ID NO: 597 (S317_gp41-1-NI), SEQ ID NO: 598 (T318_gp41-1-NI), SEQ ID NO: 599 (S135_gp41-8-NI), SEQ ID NO: 600 (S269_gp41-8-NI), SEQ ID NO: 601 (S293_gp41-8-NI), SEQ ID NO: 602 (S317_gp41-8-NI), SEQ ID NO: 603 (T318_gp41-8-NI), SEQ ID NO: 604 (S135_NrdJ-1-NI), SEQ ID NO: 605 (S269_NrdJ-1-NI), SEQ ID NO: 606 (S293_NrdJ-1-NI), SEQ ID NO: 607 (S317_NrdJ-1-NI), and SEQ ID NO: 608 (T318_NrdJ-1-NI).

The polynucleotide may include a sequence encoding a second portion of the intein-modified protease. The second portion may include a C-intein of the intein and a C-extein of the target protease. The carboxy terminus of the C-intein may be fused to the amino terminus of the C-extein. The polynucleotide may include a sequence with at least 70, 72, 75, 80, 85, 90, 91, 92, 93, 94, 95, 96, 97, 98, 99, or 100% identity to a reference sequence selected from the group consisting of: SEQ ID NO: 94 (DnaE-C:T108-Q53521-C), SEQ ID NO: 96 (DnaE-C:S154-Q53521-C), SEQ ID NO: 98 (DnaE-C:S234-Q53521-C), SEQ ID NO: 100 (DnaE-C: S260-Q53521-C), SEQ ID NO: 102 (DnaE-C:S263-Q53521-C), SEQ ID NO:104 (DnaE-C:T317-Q53521-C), SEQ ID NO: 588 (IC-SUMO-6H), SEQ ID NO: 609 (S135_IMPDH-IC), SEQ ID NO: 610 (S269_IMPDH-IC), SEQ ID NO: 611 (S293_IMPDH-IC), SEQ ID NO: 612 (S317_IMPDH-IC), SEQ ID NO: 613 (T318_IMPDH-IC), SEQ ID NO: 614 (S135_gp41-1-IC), SEQ ID NO: 615 (S269_gp41-1-IC), SEQ ID NO: 616 (S293_gp41-1-IC), SEQ ID NO: 617 (S317_gp41-1-IC), SEQ ID NO: 618 (T318_gp41-1-IC), SEQ ID NO: 619 (S135_gp41-8-IC), SEQ ID NO: 620 (S269_gp41-8-IC), SEQ ID NO: 621 (S293_gp41-8-IC), SEQ ID NO: 622 (S317_gp41-8-IC), SEQ ID NO: 623 (T318_gp41-8-IC), SEQ ID NO: 624 (S135_NrdJ-1-IC), SEQ ID NO: 625 (S269_NrdJ-1-IC), SEQ ID NO: 626 (S293_NrdJ-1-IC), SEQ ID NO: 627 (S317_NrdJ-1-IC), and SEQ ID NO: 628 (T318_NrdJ-1-IC).

The polynucleotides encoding the first and the second portions of the intein-modified protease may be expressed separately. The first and the second portions may be expressed in different compartments of the host cell. The first and the second portions may be expressed in different host lines.

In an embodiment, the polynucleotide may include a sequence encoding an intein capable of effecting cis-splicing of the intein-modified protease. The polynucleotide may include a sequence with at least 70, 72, 75, 80, 85, 90, 91, 92, 93, 94, 95, 96, 97, 98, 99, or 100% identity to a reference sequence selected from the group consisting of: SEQ ID NO: 72 (mTth:EU59 intein), SEQ ID NO: 105 (VMA), SEQ ID NO: 106 (Tth), SEQ ID NO: 40 (Tth), SEQ ID NO: 119 (mTth:EU59 intein), SEQ ID NO: 634 (Cth_ATPase_BIL), SEQ ID NO: 635 (Cwa_RIR1), SEQ ID NO: 636 (Dhan_GLT1), SEQ ID NO: 637 (Fsp-CcI3_RIR1), SEQ ID NO: 638 (Gob_Hyp), SEQ ID NO: 639 (Gvi_RIR1-1), SEQ ID NO: 640 (Hhal_DnaB-1), SEQ ID NO: 641 (Hma_CDC21), SEQ ID NO: 642 (Hwa_MCM-1), SEQ ID NO: 643 (Hwa_PolB-2), SEQ ID NO: 644 (Hwa_RIR1-1), SEQ ID NO: 645 (Hwa_RIR1-2), SEQ ID NO: 646 (Hwa_r-Pol_App), SEQ ID NO: 647 (Kra_DnaB), SEQ ID NO: 648 (Mca_RIR1), SEQ ID NO: 649 (Memar_Pol-II), SEQ ID NO: 650 (Mex_helicase), SEQ ID NO: 651 (Mhu_Pol-II), SEQ ID NO: 652 (Mja_Klba), SEQ ID NO: 653 (Mja_PEP), SEQ ID NO: 654 (Mja_Pol-2), SEQ ID NO: 655 (Mja_RFC-3), SEQ ID NO: 656 (Mja_r-Gyr), SEQ ID NO: 657 (MP-Be_gp51), SEQ ID NO: 658 (Nsp-PCC7120_RIR1), SEQ ID NO: 659 (Pab_RIR1-3), SEQ ID NO: 660 (Pfu_KlbA), SEQ ID NO: 661 (Pho_IF2), SEQ ID NO: 662 (Pho_r-Gyr), SEQ ID NO: 663 (Pno_RPA2), SEQ ID NO: 664 (SaP-SETP3_Helicase), SEQ ID NO: 665 (StP-Twort_ORF6), SEQ ID NO: 666 (Ter_DnaE-2), SEQ ID NO: 667 (Ter_RIR1-3), SEQ ID NO: 668 (Tko_Helicase), SEQ ID NO: 669 (Tko_Pol-2_Pko_Pol-2), SEQ ID NO: 670 (Tvo_VMA), SEQ ID NO: 671 (Tvu_DnaE-n_NC-terminal), SEQ ID NO: 672 (Unc-ERS_RIR1), SEQ ID NO: 673 (Synthetic construct Unc-ERS_RIR1_var7), SEQ ID NO: 699 (mVMA:P77Cd), and SEQ ID NO: 700 (mTth:P77Cd).

In an embodiment, the polynucleotide comprise, consist essentially of, or consist of a sequence with at least 70, 72, 75, 80, 85, 90, 91, 92, 93, 94, 95, 96, 97, 98, 99, or 100% identity to a reference sequence selected from the group consisting of: SEQ ID NO: 107 (Savinase-S114:VMA), SEQ ID NO: 108 (Savinase-T148:VMA), SEQ ID NO: 109 (Savinase-S166:VMA), SEQ ID NO: 110 (Savinase-S253: VMA), SEQ ID NO: 111 (Savinase-S269:VMA), SEQ ID NO: 112 (Savinase-S347:VMA), SEQ ID NO: 113 (Savinase-S114:Tth), SEQ ID NO: 114 (Savinase-T148:Tth), SEQ ID NO: 115 (Savinase-S166:Tth), SEQ ID NO: 116 (Savinase-S253:Tth). SEQ ID NO: 117 (Savinase-S269: Tth), SEQ ID NO: 118 (Savinase-S347:Tth), SEQ ID NO:

73 (ProSavinase S46-mTth:EU59), SEQ ID NO: 74 (ProSavinase S62-mTth:EU59), SEQ ID NO: 75 (ProSavinase T77-mTth:EU59), SEQ ID NO: 76 (ProSavinase S86-mTth: EU59), SEQ ID NO: 77 (ProSavinase S100-mTth:EU59), SEQ ID NO: 78 ProSavinase T109-mTth:EU59, SEQ ID NO: 79 (ProSavinase S135-mTth:EU59), SEQ ID NO: 80 (ProSavinase T148-mTth:EU59), SEQ ID NO:SEQ ID NO: 81 (ProSavinase S166-mTth:EU59), SEQ ID NO: 82 (ProSavinase T167-mTth:EU59), SEQ ID NO: 83 (ProSavinase S196-mTth:EU59), SEQ ID NO: 84 (ProSavinase S208-mTth:EU59), SEQ ID NO: 85 (ProSavinase S239-mTth: EU59), SEQ ID NO:86 (ProSavinase T243-mTth:EU59), SEQ ID NO: 87 (ProSavinase S269-mTth:EU59), SEQ ID NO: 88 (ProSavinase T285-mTth:EU59), SEQ ID NO:89 (ProSavinase S293-mTth:EU59), SEQ ID NO: 90 (ProSavinase S317-mTth:EU59), SEQ ID NO: 91 (ProSavinase_T318-mTth:EU59), SEQ ID NO: 92 (ProSavinase_T329-mTth:EU59), SEQ ID NO: 545 (ProSavinase_S135:15: Cth_ATPase_BIL), SEQ ID NO: 546 (ProSavinase_S135: 38: Hwa_rPol_App), SEQ ID NO: 547 (ProSavinase_S135: 39: Kra_DnaB), SEQ ID NO: 548 (ProSavinase_S135: 48: Mja_KIba), SEQ ID NO: 549 (ProSavinase_S135: 54: Mja_Pol-2), SEQ ID NO: 550 (ProSavinase_S135: 54: Mja_RFC-3), SEQ ID NO: 551 (ProSavinase_S135: 55: Mja_r-Gyr), SEQ ID NO: 552 (ProSavinase_S135: 142: Tko_Helicase), SEQ ID NO: 553 (ProSavinase_S135: 145: Tko_Pol-2_Pko_Pol-2), SEQ ID NO: 554 (ProSavinase_S135: 153: Tvo_VMA), SEQ ID NO: 555 (ProSavinase_S135:154: Tvu_DnaE-n_NC-terminal), SEQ ID NO: 556 (ProSavinase_S317:19: Cwa_RIR1), SEQ ID NO: 557 (ProSavinase_S317: 20: Dhan_GLT1), SEQ ID NO: 558 (ProSavinase_S317: 21: Fsp-CcI3_RIR1), SEQ ID NO: 559 (ProSavinase_S317: 23: Gob_Hyp), SEQ ID NO: 560 (ProSavinase_S317: 24: Gvi_RIR1-1), SEQ ID NO: 561 (ProSavinase_S317: 25: Hhal_DnaB-1), SEQ ID NO: 562 (ProSavinase_S317: 26: Hma_CDC21), SEQ ID NO: 563 (ProSavinase_S317: 31: Hwa_MCM-1), SEQ ID NO: 564 (ProSavinase_S317: 33: Hwa_PolB-2), SEQ ID NO: SEQ ID NO: 565 (ProSavinase_S317: 36: Hwa_RIR1-1), SEQ ID NO: 566 (ProSavinase_S317: 37: Hwa_RIR1-2), SEQ ID NO: 567 (ProSavinase_S317: 39: Kra_DnaB), SEQ ID NO: 568 (ProSavinase_S317: 40: Mca_RIR1), SEQ ID NO: 569 (ProSavinase_S317: 41: Memar_Pol-II), SEQ ID NO: 570 (ProSavinase_S317: 42: Mhu_Pol-II), SEQ ID NO: 571 (ProSavinase_S317: 43: Mhu_Pol-II), SEQ ID NO: 572 (ProSavinase_S317: 49: Mja_PEP), SEQ ID NO: 573 (ProSavinase_S317: 68: MP-Be_gp51), SEQ ID NO: 574 (ProSavinase_S317: 78: Nsp-PCC7120_RIR1), SEQ ID NO: 575 (ProSavinase_S317: 90: Pab_RIR1-3), SEQ ID NO: 576 (ProSavinase_S317: 98: Pfu_KlbA), SEQ ID NO: 577 (ProSavinase_S317: 103: Pho_IF2), SEQ ID NO: 578 (ProSavinase_S317: 108: Pho_r-Gyr), SEQ ID NO: 579 (ProSavinase_S317: 112: Pno_RPA2), SEQ ID NO: 580 (ProSavinase_S317: 118: Sap-SETP3_Helicase), SEQ ID NO: 581 (ProSavinase_S317:127: StP-Twort_ORF6), SEQ ID NO: 582 (ProSavinase_S317: 131: Ter_DnaE-2), SEQ ID NO: 583 (ProSavinase_S317: 134: Ter_RIR1-3), SEQ ID NO: 584 (ProSavinase_S317: 142: Tko_Helicase), SEQ ID NO: 585 (ProSavinase_S317: 145: Tko_Pol-2_Pko_Pol-2), SEQ ID NO: 586 (ProSavinase_S317: 155: Unc-ERS_RIR1), SEQ ID NO: 701 (iproSavS135:mVMA:P77Cd), SEQ ID NO: 702 (iproSavS265:mVMA:P77Cd), SEQ ID NO: 703 (iproSavS269:mVMA:P77Cd), SEQ ID NO: 704 (iproSavS293:mVMA:P77Cd), SEQ ID NO: 705 (iproSavS312:mVMA:P77Cd), SEQ ID NO: 706 (iproSavS317:mVMA:P77Cd), SEQ ID NO: 707 (iproSavS326:mVMA:P77Cd), SEQ ID NO: 708 (iproSavS135:mTth:P77Cd), SEQ ID NO: 709 (iproSavS269:mTth:P77Cd), SEQ ID NO: 710 (iproSavS293:mTth:P77Cd), and SEQ ID NO: 711 (iproSavS317:mTth:P77Cd).

A polynucleotide sequence in an expression cassette, isolated nucleic acid, vector, or any other DNA construct herein, or utilized in a method herein may be operably connected to one or more regulatory element. A regulatory element included may be a promoter. The promoter may be a constitutive promoter which provides transcription of the polynucleotide sequences throughout the plant in most cells, tissues and organs and during many but not necessarily all stages of development. The promoter may be an inducible promoter, which initiates transcription of the polynucleotide sequences only when exposed to a particular chemical or environmental stimulus. The promoter may be specific to a host. The promoter may be suitable for expression of the polynucleotide in a plant, a bacterium, or yeast. The promoter may be a plant specific promoter. The promoter may be specific to a particular developmental stage, organ or tissue. A tissue specific promoter may be capable of initiating transcription in a particular plant tissue. Plant tissue that may be targeted by a tissue specific promoter may be but is not limited to a stem, leaves, trichomes, anthers, or seed. A constitutive promoter herein may be the rice Ubiquitin 3 promoter (OsUbi3P) or rice Actin 1 promoter. Other known constitutive promoters may be used, and include but are not limited to Cauliflower Mosaic Virus (CAMV) 35S promoter, the Cestrum Yellow Leaf Curling Virus promoter (CMP) or the CMP short version (CMPS), the Rubisco small subunit promoter, and the maize ubiquitin promoter. The tissue specific promoter may include the seed-specific promoter. The seed specific promoter may be but is not limited to the rice GluB4 promoter or the maize zein promoter.

The promoter may be suitable for expressing the polynucleotide in a bacterium. The promoter may be the T7 RNA polymerase promoter, the LAC promoter or the arabinose promoter. The promoter may be suitable for expressing the polynucleotide in a yeast. The promoter may be the GAL promoter or the glucose promoter. Another regulatory element that may be provided is a terminator sequence, which terminates transcription. A terminator sequence may be included at the 3' end of a transcriptional unit of the expression cassette. The terminator may be derived from a variety of plant genes. The terminator may be a terminator sequence from the nopaline synthase or octopine synthase genes of *Agrobacterium tumefaciens*. The terminator may sequence may be any other terminator sequence.

Vectors incorporating an expression cassette herein may also include additional genetic elements such as multiple cloning sites to facilitate molecular cloning and selection markers to facilitate selection.

In an embodiment, an expression cassette may be optimized for expression in a plant. The expression cassette may comprise, consist essentially of, or consist of a polynucleotide having a sequence with at least 70, 72, 75, 80, 85, 90, 91, 92, 93, 94, 95, 96, 97, 98, 99, or 100% identity to a reference sequence selected from the group consisting of SEQ ID NO: 44 (pAG2209), SEQ ID NO: 45 (pAG2210), SEQ ID NO: 46 (pAG2211), SEQ ID NO: 47 (pAG2212), SEQ ID NO: 48 (pAG2216), SEQ ID NO: 49 (pAG2217), SEQ ID NO: 50 (pAG2218), SEQ ID NO: 51 (pAG2219), SEQ ID NO: 52 (pAG2220), SEQ ID NO: 53 (pAG2221), SEQ ID NO: 54 (pAG2222), and SEQ ID NO: 55 (pAG2223).

In an embodiment, an expression cassette herein may be optimized for expression in a bacterium. The expression cassette may be optimized for expression in *E. coli*. The expression cassette may comprise, consist essentially of, or consist of a polynucleotide having a sequence with at least 70, 72, 75, 80, 85, 90, 91, 92, 93, 94, 95, 96, 97, 98, 99, or 100% identity to a reference sequence selected from the group consisting of: SEQ ID NO: 60 (pHT01-pre-proSavinase-8His), SEQ ID NO: 62 (pHT01-proSavinase-8His), SEQ ID NO: 64 (pHT01-Savinase-8His), SEQ ID NO: 66 (pHT43-pre-proSavinase-8His), SEQ ID NO: 68 (pHT43-proSavinase-8His), and SEQ ID NO: 70 (pHT43-Savinase-8His). The polynucleotide may encode a protease that includes an amino acid sequence with at least 70, 72, 75, 80, 85, 90, 91, 92, 93, 94, 95, 96, 97, 98, 99, or 100% identity to a reference sequence selected from the group consisting of: SEQ ID NO: 61 (pHT01-pre-proSavinase-8His), SEQ ID NO: 63 (pHT01-proSavinase-8His), SEQ ID NO: 65 (pHT01-Savinase-8His), SEQ ID NO: 67 (pHT43-pre-pro-Savinase 8His), SEQ ID NO: 69 (pHT43-proSavinase-8His), and SEQ ID NO: 71 (pHT43-Savinase-8His).

In an embodiment, an expression cassette herein may be optimized for expression in a yeast. The expression cassette may comprise, consist essentially of, or consist of a polynucleotide having a sequence with at least 70, 72, 75, 80, 85, 90, 91, 92, 93, 94, 95, 96, 97, 98, 99, or 100% identity to a reference sequence of SEQ ID NO: 629 (pET22_iSAV_Hwa_S317_nuc) or SEQ ID NO: 630 (P416GALL-Ura).

An embodiment includes a vector comprising an expression cassette. The vector may be suitable for transformation of an appropriate host. The appropriate host may be but is not limited to a plant, a bacterium, or a yeast.

In an embodiment, intein-modified proteases may be expressed in any host.

An embodiment includes a host genetically engineered to express any intein-modified protease described here. The intein-modified protease may include any target protease. The target proteases may be selected from the group consisting of: EC3.4.99 proteases, EC3.4.21.62 proteases, keratinases, serine proteases, alkaline proteases, metallo proteases, cysteine proteases, aspartate proteases, ATP-dependent proteases, and Subtilisin family proteases. The host may express a keratinase. The host may express a Savinase.

The host may be a cell. The cell may be but is not limited to a plant cell, a microbial cell, a fungal cell, a mammalian cell, or an insect cell. A host may be a phage or a virus.

The host may be a microorganism. The microorganism may be but is not limited to Bacillus subtilus, B. lentus, B. licheniformis, Escherichia coli, Saccharomyces ssp., S. cerevisiae, Pichia ssp., or P. pastoris.

The host may be a plant. The plant may be but is not limited to corn, soy beans, sorghum, switchgrass, sugarcane, wheat, alfalfa, barley, or rice.

The host may be an expression host. The expression host can be tested using standard methods known in the art. The expression host may be a microbial expression host. The microbial expression host may be a single celled bacterium. The expression host may be a fungal, or archeal host, a plant expression host, an insect cell expression host, a viral expression host, a phage expression host, or a mammalian expression host. Intein-modified proteases may be expressed in expression hosts or in in vitro expression systems. Microbial expression hosts may be often preferred because of their ease of use and the broad technology platforms that are readily available for these organisms. Microbial expression hosts may include but are not limited to B. subtilus, B. lentus, B. licheniformis, Escherichia coli, Saccharomyces ssp., S. cerevisiae, Pichia ssp., P. pastoris, and others known in the art.

An embodiment includes a method of detection of an expressed intein-modified protease. Detection may include at least one of analyzing levels of mRNA encoding the intein-modified protease in the expression host using RT-PCR or Northern analysis, analyzing intein-modified protease levels within the expression host or host growth media by Western analysis or mass spectrometry, or by measuring activity levels of what the pre-spliced or spliced protease within the expression host, host tissues, or host growth media. Protease activity can be detected using many different assays including an assay that uses a labeled substrate, or tracking the concentration of a target protease on a coomassie stained gel following electrophoresis.

An embodiment provides a method of producing a protease. The method includes causing splicing of an intein-modified protease, which may be any intein-modified protease herein. The method may include obtaining an intein-modified protease.

The step of obtaining may include genetically engineering a host by transforming with an expression cassette encoding the intein-modified protease. The transformation may be but is not limited to an Agrobacterium-mediated transformation, electroporation with a plasmid DNA, a DNA uptake, a biolistic transformation, a virus-mediated transformation, or a protoplast transformation. The transformation may be any other transformation procedure suitable for a particular host.

In an embodiment, the method may include a step of making the expression cassette prior to transformation. The step of making the expression cassette may include selecting the target protease. The target protease may be selected from the group consisting of: EC3.4.99 proteases, EC3.4.21.62 proteases, keratinases, serine proteases, alkaline proteases, metallo proteases, cysteine proteases, aspartate proteases, ATP-dependent proteases, and Subtilisin family proteases. The step of making the expression cassette may include inserting a polynucleotide encoding the intein into a nucleic acid encoding the target protease immediately prior to one or more portions of the sequence encoding a cysteine, a serine or a threonine residue.

The polynucleotide encoding the intein may be inserted into a portion of the nucleic acid that encodes the catalytic domain of the target protease. The insertion of the intein into the catalytic domain may render the target protease inactive. The polynucleotide encoding the intein may be inserted into a portion of the nucleic acid that encodes a splitting site of the catalytic domain. The splitting sites may include amino acid positions characterized by one or more of being 1) on a surface of a secondary structure of the target protease; 2) near an end of the secondary structure; 3) between catalytic residues of a catalytic domain, or 4) close to an end of the catalytic domain.

The step of making the expression cassette may include modifying genes encoding intein-modified proteases using recombinant DNA methods, PCR methods, or by synthesizing a nucleic acid encoding the desired intein-modified protease. Using any of these methods, the nucleic acid sequence encoding the amino acid sequence of the intein may be assembled within, or fused to, the nucleic acid sequence encoding the desired target protease or a portion of the target protease. The resulting nucleic acid sequence of the intein-modified protease may encode a contiguous sequence of amino acids when a cis-splicing intein is used, or two separate nucleic acids that encode the intein-extein fusions when a trans-splicing intein is used. For any target protease and selected insertion site, it may be possible to insert any desired intein, even novel or engineered inteins. Inserting multiple inteins into a selected insertion site in a target protease may enable a method wherein it may be possible to screen and select an intein-modified protease with the desired activity properties. This process of developing an intein-modified protease may be enhanced or improved by using site-directed mutagenesis, random mutagenesis, or DNA shuffling, to create libraries of intein-modified proteases that may be screened to identify a desired intein-modified protease. This method can be used to select intein-modified proteases that can be expressed in an inactive state at 37° C., formulated in a detergent, and then become active at temperatures below 34° C., or below 20° C. when the detergent is diluted in water.

In an embodiment, the intein may splice the intein-modified protein spontaneously. The intein may cause trans-splicing of the intein-modified protease upon the first and the second portions of the intein-modified protease getting in contact with each other.

In an embodiment, the intein may be induced to cause cis-splicing of the intein-modified protease upon exposure to an induction condition.

The step of causing may include allowing a spontaneously splicing intein to splice the intein-modified protease. The step of causing may include inducing splicing by exposing an intein-modified protease to an induction condition.

The induction condition may be selected from the group consisting of: an induction temperature, an induction pH, an induction concentration of a compound, an induction compound, and an induction mixture of compounds. The induction condition may be an-induction temperature. The induction temperature intein may be a temperature lower than 37° C. The induction temperature may be a temperature lower 28° C., lower than 25° C., or lower than 20° C. The induction temperature may be a temperature less of or equal to 20° C. The induction temperature may be a temperature of 37° C., 35° C., 30° C., 25° C., 20° C., less than 37° C., less than 35° C., less than 30° C., less than 25° C., less than 20° C., 37° C. to 35° C., 35° C. to 30° C., 30° C. to 25° C., 25° C. to 20° C., or to less than 20° C.

The induction condition may be an induction concentration of the compound. The induction concentration of a compound may be a reduction in the concentration. The reduction may be but is not limited to a 10, 15, 20, 25, 30, 35, 40, 45, 50, 55, 60, 65, 70, 75, 80, 85, 90, 95, or 100% reduction. The induction concentration of the compound may be may be an increase in the concentration. The increase may be but is not limited to a 10, 15, 20, 25, 30, 35, 40, 45, 50, 55, 60, 65, 70, 75, 80, 85, 90, 95, 100%, or greater than 100% increase. The induction compound may be selected from the group consisting of: a detergent, a surfactant, a chelating agent, zinc, EDTA, an ion, and a phytic acid.

The induction compound may be a detergent. As used herein, the term "detergent" refers to a surfactant or a mixture of surfactants. The surfactants may be alkylbenzenesulfonates. The detergent may be a laundry detergent. The laundry detergents may contain water softeners, surfactants, bleach, enzymes, brighteners, fragrances, and many other agents. Laundry detergents may be provided in liquid formulations. A liquid laundry detergent formulation may include a combination of anionicand nonionic surfactants, builders to remove the hardness ions, a variety of antiredeposition agents, dye transfer inhibitors that prevent dye from coming off one fabric and getting deposited on another, soil release polymers to provide a barrier to the fabric, optical brighteners, enzyme stabilizers, viscosity control compounds, pH control compounds, soap and silicones to control excessive foaming, preservatives for microbial control, perfume and dye for scent and appearance, bleaching agents, water, solubilizers and other additives to improve performance characteristics. The anionic surfactants may be alkylbenzenesulphonates. The nonionic surfactants may be ethoxylated fatty alcohols, or any other anionic surfactants. The builder to remove the hardness ions may be sodium citrate, tetrasodium EDTA or an acrylic polymer. The dye transfer inhibitor may be PVP K-30, Chromabond S-100, or Chromabond S-400. The soil release polymer may be Sorez 100 a polyethylene glycol polyester copolymer, or Repel-O-Tex SRP-6, a polyethylene glycol polyester. The optical brightener may be Tinopal CBS-X, or any other optical brightener. The enzyme stabilizer may be calcium chloride, sodium tetraborate, propylene glycol, sodium formate, sodium citrate or monoethanolamine. The viscosity control compound may be propylene glycol, sodium xylene sulfonate, or polymers. The pH control compound may be citric acid or monoethanolamine. The detergent may be affected by the temperature of the cleaning water. The detergent may be a dishwashing detergent. The detergent may be a soapless soap. The tem "soapless soap" refers to a soap free liquid cleanser with a slightly acidic pH. The detergent may be a cleaning solution. The cleaning solution may be an industrial cleaning solution or a commercial cleaning solution. The cleaning solution may be a cleaning solution for cleaning fabrics, clothing, textiles, dishes, cutlery, consumer or industrial products, pipes, equipment, scaling, or biofilms. The detergent may be any other type of a cleaning agent. The detergent may be a powder. The detergent may be a liquid solution. The detergent may be a fuel additive. The fuel additive may be a long-chain amine or amide. The fuel additive may be a polyisobuteneamine or polyisobuteneamide/succinimide. The detergent may be a biological reagent. The biological reagent may be used for the isolation and purification of integral membrane proteins found in biological cells.

The intein-modified protease may be inactive when diluted with a detergent, and activated upon dilution of the detergent with water.

In an embodiment, the step of causing may include splicing of the intein upon dilution of a detergent with water. The ratio of the detergent to water may be selected from the value of less than or equal to one of 1:5, 1:10, 1:20, 1:50: 1:60, 1:70, 1:80, 1:90, 1:100, 1:150, 1:200, 1:250, 1:300, 1:350, or 1:400, or any value in a range between any two of the foregoing (endpoints inclusive). For example, the detergent to water ratio may be a value less than any integer or non-integer number selected from 1:5 to 1:10. The detergent-to-water ratio may be equal to 1:5, 1:10, 1:20, 1:50: 1:60, 1:70, 1:80, 1:90, 1:100, 1:150, 1:200, 1:250, 1:300, 1:350, or 1:400 or any value in a range between any to of the foregoing (endpoints inclusive). For example, the liquid to solid ratio may be a value equal to any integer or non-integer number in the range from 1:5 to 1:10.

An embodiment includes a method of regulating the activity of a protease that includes producing a protease by any methods described herein. The protease activity may be regulated during expression, purification, formulation, or in a final product. The protease activity may be regulated during an industrial, consumer, agricultural, or feed process. The consumer process may be a process of cleaning consumer products. The consumer process may be cleaning laundry or fabric items, cleaning dishes or other materials. The agricultural or feed processes may include production of meat, protein, eggs, milk, other dairy, poultry, swine, or cattle products. Use of controllable proteases may add value to a feed process. Using inteins to modify proteases, and thereby regulate or control when and how they become active, is a novel solution for improving protease production and use, as well as discovering new proteases. Depending upon the desired application, both cis- and trans-splicing inteins may be valuable in producing, formulating, and working with proteases. A cis-splicing intein may be fused to a target protease, where it may be located internally within the target protease (that is, inserted into the protease amino acid sequence), or may be fused to either the amino or carboxy terminus of the target protease. Insertion, or fusion of the intein in, or to, the target protease may be selected such that the protease's activity may be regulated by intein cleavage, splicing, or even changes in the intein-modified protease's conformation. Intein-mediated activation of a protease may be regulated by induction conditions. Induction conditions may include conditions sufficient to induce splicing of the intein in an intein-modified protease. Intein-mediated activation of a protease may be regulated by the protease expression host. In an embodiment, intein-mediated activation of a protease may occur spontaneously.

Intein-modified protease capable of cis-splicing may be expressed at an elevated temperature and formulated into a detergent, where splicing is inhibited or the protease is inactive. Upon dilution of the detergent containing the intein-modified protease, the splicing or cleavage reaction may proceed, activating the protease.

Intein-modified protease may be capable of trans-splicing. Toxic compounds are frequently handled as binary systems, split into two inactive parts, made and stored separately and brought together to create the functional compounds at time of application. A protease can be split into two inactive parts and reassembled into one functional molecule using trans-splicing inteins. See Kempe et al. (2009), showing use a trans-splicing intein for expression of the cytotoxic *Bacillus amyloliquefaciens* barnase in plants.

An intein-modified protease may be expressed as an inactive precursor, but then may be activated during formulation of an animal feed diet, or within the animal, to form an active protease that improves the nutritional characteristics of the feed. Other mechanisms of activating the intein-modified protease are also possible, depending upon the desired conditions and application.

In an embodiment, a trans-splicing intein may be inserted into a protease, separating it into two intein-modified extein proteins. When combined, these two intein-modified extein proteins may bind to activate the protease, or they may splice via intein trans-splicing to produce a mature and active enzyme. Intein trans-splicing may enable methods of protease production wherein the active protease may be assembled in vitro, or in vivo in an animal, from two inactive, or less active, precursor intein-modified exteins. Using trans-splicing, it may be possible to select for intein-modified protease exteins that can be combined in a dry form, and therefore incapable of becoming an active protease, and the protease activated upon hydration. This mechanism of formulation may be useful in animal feed and dry detergent formulations. Similarly, it may be possible to formulate intein-modified protease exteins in a high concentration of detergent, or other chemicals, wherein the protease may not be active in the initial formulation, but may become active upon dilution. Other chemicals may include zinc, EDTA, anions, cations, chelating agents, fatty acids, phytic acid, surfactants or others known in the art.

An embodiment includes a detergent that includes an intein-modified protease. The intein modified-protease may include any target protease herein. The target protease may be a Savinase.

An embodiment includes an animal feed comprising an intein-modified protease, which may be any intein-modified protease herein. To be used as an animal feed, or part of an animal feed, the intein-modified protease may be produced microbially. The intein-modified protease may be produced in plants. The target proteases may be but are not limited to enzymes used as dietary supplements, or mixes of exogenously produced enzymes. Expression of intein-modified proteases in soy beans, corn, rye, wheat, or sorghum seeds may eliminate the need for exogenously produced enzymes that must be mixed into the feed, and may be a more efficient way of preparing animal feed that may contain grain containing a target protease. Expressing an intein-modified protease in seed or grain may enable mixing of dietary supplement enzymes, or enzyme mixes, in the feed for nutritional enhancement. Enzymes and enzyme mixes have been increasingly used as additives in animal feeds to improve nutrient availability, to eliminate some of the anti-nutritional effects of the feed, and to modify microflora in the gut, especially in young animals that are most susceptible to enteric pathogens (Bedford and Partridge, 2010). Intein-modified proteases may be produced in seeds, and the seeds or intein-modified protease(s) may be at least part of an animal feed.

The intein-modified protease may be mixed with other enzymes that were reported as dietary supplements in swine and poultry feeds. The intein-modified proteases may be mixed with any one or more of a xylanase, a β-glucanase, a protease, an amylase, a phytase, or an endo-mannanase (Cowieson et al., 2005; Mathlouthi et al., 2002; Jiang et al., 2008; Liu et al., 2008a, b; Short F. M. et al. 2002; Odetallah et al., 2002a,b; Wang et al., 2006a; and Stark et al., 2009). The intein-modified protease may be mixed with other feed supplementations. The intein modified proteases may be mixed with other proteases included in various animal feed diets. The intein-modified protease may be used alone or in enzyme mixes in various poultry feed diets. The beneficial effects of protease supplement on improving efficiency of feed utilization, growth performance and decreasing mortality of immature and developing animals is documented. See Simbaya et al., 1996, Odetallah et al. 2003, Wang et al. 2006, all of which are incorporated by reference as if fully set forth. The intein-modified protease may be mixed with other proteases supplemented poultry diets in the market including but not limited to various Avizyme® feeds (Danisco) or the Versazyme® keratinase PWD-1 (BioResource International Inc.). The proteases supplemented poultry diets may be used as target proteases.

An embodiment includes an intein-modified protease which includes a keratinase as a target protease. Keratinases appear to have independently and convergently evolved an Asp/Ser/His catalytic triad, similar to that found in the trypsin serine proteases (pfam00089). PWD-1 keratinase was isolated and characterized from the feather degrading bacterium *Bacillus licheniformis* PWD-1 (Lin et al., 1992). The *B. licheniformis* PWD-1 keratinase (Q53521) belongs to the subtilase family of serine proteases. This enzyme has been used to produce hydrolyzed feather meal, and has potential use in various applications in the animal feed, leather, fertilizer, detergent and pharmaceutical industries (Gupta and Ramnani, 2006; Brandelli, 2008, Brandelli et al., 2010). To be used as a feed additive, keratinase is made as a crude dried cell-free fermentation product from keratinase producing *B. licheniformis* PWD-1. It would be beneficial to directly produce keratinase in a feed plant, crop, tissue, or grain rather than to use the microbially produced keratinase as a feed additive. Keratinase may be produced in any transgenic feed plants, crops, tissues, or grain including any of those from corn (stover and/or grain), sorghum (grain, forage, and/or residue), or soy beans. However, keratinases are inherently difficult to produce because of their potential to harm the expression host. Expression of active keratinase could be harmful to the plant cell, in which case transgenic events expressing high levels of keratinase would be contra-selected and lost. These could be seen as aborted or defective seed development. To date there is no report on plant expressed keratinase. Among the challenges of production of the functional keratinase are cleavage of the pro-protein and proteolytic degradation of the inhibitory pro-domain. In the case where cleavage is rate limiting, a cleavage site for proteases known to be active in the plant secretory pathway could be engineered between the pro-domain and the catalytic domain. Conversely, the pro-enzyme could be targeted to the vacuole where the non-secretory pathway proteases are sequestered. Alternatively, auto-processing could be induced in post-harvest stage material by spiking in small amounts of the active keratinase.

An embodiment includes a keratinase modified for expression in a plant. The modified keratinase may be an intein-modified keratinase. The intein modified-keratinase may include a trans-splicing intein.

An embodiment includes a method for producing a keratinase, which could be expressed in a plant. Because keratinase can negatively impact seed development, keratinase may be partitioned to inactive complementing parts and re-assembled for activity at the time of application using trans-splicing inteins. Keratinase may also be expressed as a cis-splicing intein-modified protease. Keratinase may be modified to separately express the pro-domain and catalytic domain. The catalytic domain may be modified to not properly fold without the pro-domain present. The two domains may be subsequently combined. Keratinases belong to the subtilisin family that includes auto-processing proteases that are passing through a complex maturation pathway. Subtilisins are synthesized as inactive pre-pro-proteins with an N-terminal signal peptide followed by a pro-domain and a catalytic domain (Takagi and Takahashi, 2003). The signal peptide is removed during secretion across the cytoplasmic membrane generating an inactive pro-protein. The pro-domain is removed either autocatalytically or by an active subtilisin molecule to yield the functional protein (Ohta et al., 1991; Carter and Wells, 1988). The rate limiting step of maturation is not the folding or auto processing of the pro-protein to catalytic protease, but the release of the first enzymatically active catalytic protease from its association with the inhibitory pro-domain, by degradation of the pro-domain (Yabuta et al., 2001). This triggers a chain reaction that selectively and exponentially degrades the pro-domain and raises activity. It was shown that the pro-domain can act in trans-in the folding of the catalytic-domain from an inactive molten globule to active conformation. See Baker et al. 1992; Shinde and Inouye, 1995. This may be useful to control activity by expressing the pro- and the catalytic-domain separately. The keratinase may be split into two portions: the pro-domain and the catalytic domain. The catalytic domain may be also split into two portions that would render the keratinase inactive. The splitting sites may include amino acid positions characterized by being on a surface of a secondary structure of the target protease, near an end of the secondary structure between catalytic residues of a catalytic domain, or close to an end of the catalytic domain. The Q53521 keratinase sites for potential secondary modifications in the plant are described in Table 1. These sites could be altered by conservative replacements of amino acid residues, or by other means to decrease the probability of post-translational modifications to the plant expressed protease.

TABLE 1

Potential secondary modification sites of Q53521.

| | |
|---|---|
| NetNGlyc 1.0 | predicted N-glycosylated asparagines at two sites: at residue 181 in NTTG (score 0.6397) at residue 322 in NGTS (score 0.7178) |
| NetOglyc 3.1 | predicted O-glycosylation at two sites: at residue T 317 (G score: 0.511) at residue T 320 (G score: 0.500) |
| NetPhos 2.0 | predicted 15 serine and 3 tyrosine phosphorylation sites |
| NetPhosK 1.0 | predicted 1 PKC phosphorylation site at position S52 (score 0.89) |

Prediction tools at http://expasy.org/proteomics: NetNGlyc 1.0, NetOglyc 3.1, NetPhos 2.0, NetPhosK 1.0, OGPET, YinOYang 1.2, Big-PI, NMT, PrePS and Sulfinator were applied onto the full length Q53521. Hits are listed in Table 1.

The keratinase may be split into N- and C-exteins. Each of N- and C-exteins may be fused with parts of a trans-splicing intein to form the inactive trans-splicing NI and IC pairs. The NI and IC pairs may be separately expressed under the control of early germination stage inducible promoter(s) in male and female plants. Crossing the plants may generate hybrid seed that does not express keratinase and develops normally. Seed imbibition may induce co-expression of inactive trans-splicing parts that re-assemble and may generate the active keratinase during early stage of germination. The advantages of the separate expression of the trans-splicing parts of the intein-modified keratinase are as follows: i) expression into the germinating seed does not effect normal seed development and seed setting; ii) keratinase could facilitate protein breakdown in the seed and potentially improve nutritional value of the feed; iii) concomitant sugar mobilization from starch in the germinating seed can further improve nutritional value; iv) producing keratinase using hybrid seed technology provides increased value; v) keratinase toxicity in the germinating seed would be a bonus, providing means to control the spread of the functional transgene; vi) it could be possible to engineer gastric labile trans splicing Q53521 parts (NI and IC) for plant expression, and still regain sufficient stability in the active keratinase for protein degradation in the animal gut. It may also be possible to express the keratinase directly in green tissues of the plants, where it is targeted to the cell wall and not interfere with other cellular or plant functions. Separate expression in male and female plants of trans-splicing parts of a protease under the control of germination inducible promoters may have broad utility in seed expression of harmful proteases that effect normal seed development and/or fertility and seed setting.

Embodiments include the compositions produced by one or more steps of the methods herein.

EMBODIMENTS

The following list includes particular embodiments. The list, however, is not limiting and does not exclude the embodiments otherwise described herein or alternate embodiments.

1. An intein-modified protease comprising a target protease and an intein fused to the target protease in such a position as to control the activity of the target protease, wherein the intein is capable of effecting splicing of the intein-modified protease.

2. The intein-modified protease of embodiment 1, wherein the intein is fused in such a position as to substantially reduce or inhibit the activity of the target protease.

3. The intein-modified protease of any one or more embodiments 1-2, wherein the target protease is an enzyme selected from the group consisting of: EC3.4.99 proteases, EC3.4.21.62 proteases, keratinases, serine proteases, alkaline proteases, metallo proteases, cysteine proteases, aspartate proteases, ATP-dependent proteases, and Subtilisin family proteases.

4. The intein-modified protease of any one or more embodiments 1-3, wherein the target protease comprises keratinase.

5. The intein-modified protease of any one or more embodiments 1-3, wherein the target protease comprises savinase.

6. The intein-modified protease of any one or more embodiments 1-5, wherein the target protease includes a sequence with at least 90% identity to a reference sequence selected from the group consisting of SEQ ID NOS: 1-12, 57-58, and 718.

7. The intein-modified protease of any one or more embodiments 1-6, wherein the intein is capable of effecting trans-splicing of the intein-modified protease, and the intein-modified protease comprises: i) a first portion having an N-extein of the target protease, and an N-intein of the intein and the carboxy terminus of the N-extein is fused to the amino terminus of the N-intein; and ii) a second portion having a C-intein of the intein and a C-extein of the target protease, and the carboxy terminus of the C-intein is fused to the amino terminus of the C-extein; wherein the first portion is separated from the second portion prior to splicing of the intein-modified protease.

8. The intein-modified protease of any one or more embodiments 1-7, wherein the N-intein includes a sequence with at least 90% identity to a reference sequence selected from the group consisting of: SEQ ID NO: 38, SEQ ID NO: 537, SEQ ID NO: 539, SEQ ID NO: 541, and SEQ ID NO: 543.

9. The intein-modified protease of any one or more embodiments 1-8, wherein the C-intein includes a sequence with at least 90% identity to a reference sequence selected from the group consisting of: SEQ ID NO: 39, SEQ ID NO: 538, SEQ ID NO: 540, SEQ ID NO: 542, and SEQ ID NO: 544.

10. The intein-modified protease of any one or more embodiments 1-8, wherein the first portion includes a sequence with at least 90% identity to a reference sequence selected form the group consisting of: SEQ ID NO: 13, SEQ ID NO: 15, SEQ ID NO: 17, SEQ ID NO: 19, SEQ ID NO: 21, SEQ ID NO: 23, SEQ ID NO: 454, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, and SEQ ID NO: 475.

11. The intein-modified protease of any one or more embodiments 1-11, wherein the second portion includes a sequence with at least 90% identity to a reference sequence selected form the group consisting of: SEQ ID NO: 14, SEQ ID NO: 16, SEQ ID NO: 18, SEQ ID NO: 20, SEQ ID NO: 22, SEQ ID NO: 24, SEQ ID NO: 455, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO:487, SEQ ID NO: 488, SEQ ID NO: 489, SEQ ID NO: 490, SEQ ID NO: 491, SEQ ID NO: 492, SEQ ID NO: 493, SEQ ID NO: 494, and SEQ ID NO: 495.

12. The intein-modified protease of any one or more embodiments 1-6, wherein the intein is capable of effecting cis-splicing of the intein-modified protease.

13. The intein-modified protease of any one or more embodiments 1-6, and 12, wherein the intein includes a sequence with at least 90% identity to a reference sequence selected from the group consisting of: SEQ ID NO: 37, SEQ ID NO: 40, SEQ ID NO: 119, SEQ ID NOS: 497-533, and SEQ ID NOS: 684-685.

14. The intein-modified protease of any one or more embodiments 1-6, and 12-13 that includes a sequence with at least 90% identity to a reference sequence selected form the group consisting of: SEQ ID NOS: 25-36, SEQ ID NOS: 120-453, SEQ ID NO: 496, and SEQ ID NOS: 686-696.

15. The intein-modified protease of any one or more embodiments 1-6 and 12-14, wherein the intein is inducible to cause cis-splicing of the intein-modified protease by exposure to an induction condition, wherein the induction condition is at least one condition selected from the group consisting of: an induction temperature, an induction pH, an induction concentration of a compound, an induction compound, and an induction mixture of compounds.

16. The intein-modified protease of any one or more embodiments 1-6 and 12-15, wherein the induction condition is an induction temperature, and the induction temperature is a temperature lower than 37° C.

17. The intein-modified protease of any one or more embodiments 1-6 and 12-16, wherein the induction temperature is a temperature lower than 28° C., lower than 25° C., or lower than 20° C.

18. The intein-modified protease of any one or more embodiments 1-6 and 12-15, wherein the induction condition is an induction concentration of a compound, wherein the compound is selected from the group consisting of: a detergent, a surfactant, a chelating agent, zinc, EDTA, and phytic acid.

19. The intein-modified protease of any one or more embodiments 1-6, 12-15, and 18, wherein the intein is inducible to cause cis-splicing of the intein-modified protease by exposure to an induction condition including an induction compound and an induction concentration of the compound, and the induction compound is a detergent, and the induction concentration of the detergent in a dilution with water is a detergent:water ratio less or equal to one selected from the group consisting of: of 1:5, 1:10, 1:20, 1:50: 1:60, 1:70, 1:80, 1:90, 1:100, 1:150, 1:200, 1:250, 1:300, 1:350, and 1:400.

20. An expression cassette comprising a polynucleotide encoding an intein-modified protease that includes a target protease and an intein fused to the target protease in such a position as to control the activity of the target protease, wherein the intein is capable of effecting splicing of the intein-modified protease.

21. The expression cassette of embodiment 20, wherein the intein is fused in such a position as to substantially reduce or inhibit the activity of the target protease.

22. The expression cassette of any one or more embodiments 20-21, wherein the polynucleotide comprises a sequence encoding a keratinase.

23. The expression cassette of any one or more embodiments 20-21, wherein the polynucleotide comprises a sequence encoding a Savinase.

24. The expression cassette of any one or more embodiments 20-23, wherein the polynucleotide comprises a sequence with at least 90% identity to a reference sequence of SEQ ID NO: 41 or SEQ ID NO: 59.

25. The expression cassette of any one or more embodiments 20-24, wherein the polynucleotide comprises a sequence encoding an intein capable of effecting trans-splicing of the intein-modified protease, and the intein-modified protease comprises: i) a first portion having an N-extein of the target protease, and an N-intein of the intein, and the carboxy terminus of the N-extein is fused to the amino terminus of the N-intein; and ii) a second portion having a C-intein of the intein and a C-extein of the target protease, and a carboxy terminus of the C-intein is fused to the amino terminus of the C-extein; wherein the first portion is separated from the second portion prior to splicing of the intein-modified protease.

26. The expression cassette of any one or more embodiments 20-25, wherein the sequence has at least 90% identity to a reference sequence selected from the group consisting of: SEQ ID NOS: 42-43, and SEQ ID NOS: 674-681.

27. The expression cassette of any one or more embodiments 20-26, wherein the sequence has at least 90% identity to a reference sequence selected from the group consisting of: SEQ ID NO: 93, SEQ ID NO: 95, SEQ ID NO: 97, SEQ ID NO: 99, SEQ ID NO:101, SEQ ID NO:103, SEQ ID NO: 587, and SEQ ID NOS: 569-608.

28. The expression cassette of any one or more embodiments 20-27, wherein the polynucleotide comprises a sequence with at least 90% identity to a reference sequence selected from the group consisting of: SEQ ID NO: 94, SEQ ID NO: 97, SEQ ID NO: 98, SEQ ID NO:100, SEQ ID NO: 102, SEQ ID NO:104, SEQ ID NO: 588, and SEQ ID NOS: 609-628.

29. The expression cassette of any one or more embodiments 20-24, wherein the polynucleotide comprises a sequence encoding an intein capable of effecting cis-splicing of the intein-modified protease.

30. The expression cassette of any one of embodiments 20-24, and 29, wherein the polynucleotide comprises a sequence with at least 90% identity to a reference sequence selected from the group consisting of: SEQ ID NO: 40, SEQ ID NO: 72, SEQ ID NOS: 105-106, SEQ ID NO: 119, SEQ ID NOS: 634-673, and SEQ ID NOS: 699-700.

31. The expression cassette of any one or more embodiments 20-24, 29-30, wherein the polynucleotide comprises a sequence with at least 90% identity to a reference sequence selected from the group consisting of: SEQ ID NOS: 73-92, SEQ ID NOS: 107-118, SEQ ID NOS: 545-586, and SEQ ID NOS: 701-711.

32. The expression cassette of embodiment 20, wherein the intein-modified protein is the intein modified protein of any one or more embodiments 2-19.

33. An expression cassette comprising a polynucleotide that includes a sequence with at least 90% identity to a reference sequence selected from the group consisting of SEQ ID NOS: 44-55.

34. An expression cassette comprising a polynucleotide that includes a sequence with at least 90% identity to a reference sequence of SEQ ID NO: 629 or SEQ ID NO: 630.

35. A host genetically engineered to express the intein-modified protease of any one or more embodiments 1-19.

36. The host of embodiment 35, wherein the host is selected from the group consisting of: a plant cell, a microbial cell, a fungal cell, a mammalian cell, a phage, a virus, and an insect cell.

37. The host of any one or more embodiments 35-36, wherein the host is a microorganism selected from the group consisting of: *Bacillus* subtilus, *Bacillus lentus*, *Bacillus licheniformis*, *Escherichia coli*, *Saccharomyces* ssp., *Saccharomyces cerevisiae*, *Pichia* ssp., and *Pichia pastoris*.

38. The host of any one or more embodiments 35-36, wherein the host is a plant selected from the group consisting of: corn, soy beans, sorghum, switchgrass, sugarcane, wheat, alfalfa, barley, and rice rice.

39. A method of producing a protease comprising causing splicing of an intein-modified protease, wherein the intein-modified protease is the intein modified protease of one or more embodiments 1-19.

40. The method of embodiment 39 further comprising obtaining the intein-modified protease.

41. The method of any one or more embodiments 39-40, wherein the step of obtaining comprises genetically engineering a host by transforming the host with an expression cassette encoding the intein-modified protease.

42. The method of any one or more embodiments 39-41 further comprising making the expression cassette prior to the step of transforming.

43. The method of any one or more embodiments 39-42, wherein the step of making the expression cassette includes selecting the target protease from the group consisting of: EC3.4.99 proteases, EC3.4.21.62 proteases, keratinases, serine proteases, alkaline proteases, metallo proteases, cysteine proteases, aspartate proteases, ATP-dependent proteases, and Subtilisin family proteases.

44. The method of any one or more embodiments 39-43, wherein the step of making the expression cassette includes inserting a polynucleotide encoding the intein into a nucleic acid encoding the target protease immediately prior to one or more portions of the sequence encoding a cysteine, a serine or a threonine residue.

45. The method of any one or more embodiments 39-44, wherein the polynucleotide encoding the intein is inserted into a portion of the nucleic acid that encodes the catalytic domain of the target protease, and the insertion of the intein into the catalytic domain renders the target protease inactive.

46. The method of any one or more embodiments 39-45, wherein the polynucleotide encoding the intein is inserted into a portion of the nucleic acid that encodes a splitting site of the catalytic domain, wherein the splitting site includes amino acid positions characterized by one or more of being 1) on a surface of a secondary structure of the target protease; 2) near an end of the secondary structure; 3) between catalytic residues of a catalytic domain, or 4) close to an end of the catalytic domain.

47. The method of any one one or more embodiments 39-46, wherein the intein is capable of effecting trans-splicing of the intein-modified protease.

48. The method of any one or more embodiments 39-47, wherein the intein splices spontaneously, and causing includes allowing the intein to splice.

49. The method of any one or more embodiments 38-46, wherein the intein is inducible to cause cis-splicing upon exposure to an induction condition that is at least one condition selected from the group consisting of an induction temperature, an induction pH, an induction concentration of a compound, an induction compound, or an induction mixture of compounds, and causing includes exposing the intein-modified protein to the induction condition.

50. The method of any one or more embodiments 39-46 and 49, wherein the induction condition is an induction temperature, wherein the induction temperature is a temperature lower than 37° C.

51. The method of any one or more embodiments 39-46 and 49-50, wherein the induction temperature is a temperature lower than 280° C., lower than 25° C., or lower than 20° C.

52. The method of any one or more embodiments 39-46 and 49, wherein the induction condition is an induction concentration of a compound, wherein the compound is selected from the group consisting of: a detergent, a surfactant, a chelating agent, zinc, EDTA, and phytic acid.

53. The method of any one or more embodiments 39-46, 49 and 52, wherein the compound is a detergent, and the induction concentration of the detergent in a dilution with water is a detergent:water ratio less or equal to one selected from the group consisting of: 1:5, 1:10, 1:20, 1:50: 1:60, 1:70, 1:80, 1:90, 1:100, 1:150, 1:200, 1:250, 1:300, 1:350, and 1:400 of a detergent to water.

54. The method of any one or more embodiments 39-53, wherein the activity of the target protease is substantially reduced or inhibited.

55. The method of any one or more embodiments 39-54, wherein the target protease restores activity upon splicing of the intein-modified protease.

56. An animal feed comprising an intein-modified protease of any one or more embodiments 1-19.

57. A detergent comprising an intein-modified protease of any one or more embodiments 1-19.

Further embodiments herein may be formed by supplementing an embodiment with one or more element from any one or more other embodiment herein, and/or substituting one or more element from one embodiment with one or more element from one or more other embodiment herein.

EXAMPLES

The following non-limiting examples are provided to illustrate particular embodiments. The embodiments throughout may be supplemented with one or more detail from one or more example below, and/or one or more element from an embodiment may be substituted with one or more detail from one or more example below.

Example 1. Experimental Overview

For keratinase expression for animal feed the following steps were performed: The *B. licheniformis* PWD-1 keratinase (Q53521) could be expressed as pro-enzyme in an endosperm or embryo of corn seed. An expression cassette were optimized, different codon optimized versions of the coding sequence were tested, promoters, 5'-UTR introns, and targeting signals were evaluated. Fertility, seed setting and seed viability were examined. Multiple T1 seeds from single events were screened to identify high expressors. Molecular mass, accumulation level and activity were examined, and specific activity, MW, pH and temperature optimum of seed expressed keratinase were compared with those of the microbially produced. Seed expressed keratinase may be evaluated as a substitute for the microbial keratinase in feeding tests. Breeding keratinase into elite inbred germplasm(s) may be started for commercializable feed product. Alternative strategies were explored to produce keratinase using cis- or trans-splicing inteins. The separate pro-domain and catalytic domain were expressed individually and subsequently mixed to associate pro-domain with the catalytic domain, to help refold the protein and recover activity.

Example 2. Expression of Q53521 Keratinase Pro-Enzyme in Corn Seed

A corn codon optimized gene of the Q53521 keratinase from *Bacillus licheniformis* (gi 998767) (SEQ ID NO: 12) was synthesized. The codon optimized gene of Q53521 was cloned into pUC57 to create pUC57: FProtQ53. To support cloning between the EcoRI and XhoI sites of the pBluescript and the lambda phage Uni ZAP XR (Agilent), the XhoI site (CTCGAG) at bp 898-903 was removed by silent mutation of the C900 to G using site directed mutagenesis (marked above the sequence). Plant expression constructs carry the intact XhoI site.

Nucleotide and protein sequences of the corn codon optimized Q53521 keratinase of *Bacillus licheniformis*:

```
ATGATGAGGAAGAAGTCCTTCTGGCTTGGCATGCTGACAGCCTTCATGC
 M  M  R  K  K  S  F  W  L  G  M  L  T  A  F  M  L

TGGTGTTCACGATGGCTTTCTCCGACAGCGCTTCTGCTGCTCAGCCAGC
 V  F  T  M  A  F  S  D  S  A  S  A  A  Q  P  A

TAAGAACGTGGAGAAGGATTACATCGTCGGCTTCAAGAGCGGCGTCAAG
 K  N  V  E  K  D  Y  I  V  G  F  K  S  G  V  K

ACAGCTTCTGTTAAGAAGGACATCATTAAGGAGAGCGGCGGCAAGGTTG
 T  A  S  V  K  K  D  I  I  K  E  S  G  G  K  V  D

ATAAGCAATTCAGAATCATTAACGCGGCCAAGGCTAAGCTCGACAAGGA
  K  Q  F  R  I  I  N  A  A  K  A  K  L  D  K  E

GGCGCTTAAGGAGGTGAAGAATGACCCGGATGTTGCCTACGTGGAGGAG
 A  L  K  E  V  K  N  D  P  D  V  A  Y  V  E  E

GATCACGTCGCCCATGCTCTGGCGCAGACTGTTCCGTACGGCATCCCAC
 D  H  V  A  H  A  L  A  Q  T  V  P  Y  G  I  P  L

TCATTAAGGCCGACAAGGTGCAGGCTCAAGGCTTCAAGGGCGCGAACGT
  I  K  A  D  K  V  Q  A  Q  G  F  K  G  A  N  V

GAAGGTCGCCGTTCTTGACACCGGCATCCAAGCTTCACACCCTGATCTG
 K  V  A  V  L  D  T  G  I  Q  A  S  H  P  D  L

AATGTGGTCGGAGGAGCTTCGTTCGTCGCTGGAGAGGCCTACAACACTG
 N  V  V  G  G  A  S  F  V  A  G  E  A  Y  N  T  D

ACGGAAATGGCCACGGCACCCATGTGGCTGGCACTGTCGCTGCGCTTGA
 G  N  G  H  G  T  H  V  A  G  T  V  A  A  L  D

TAACACCACTGGAGTCCTGGGCGTTGCTCCATCAGTGTCGCTGTACGCT
 N  T  T  G  V  L  G  V  A  P  S  V  S  L  Y  A

GTGAAGGTCCTCAACTCCAGCGGCTCCGGCAGCTACTCTGGCATCGTGT
 V  K  V  L  N  S  S  G  S  G  S  Y  S  G  I  V  S

CTGGCATTGAGTGGGCTACAACGAACGGCATGGACGTCATTAATATGAG
 G  I  E  W  A  T  T  N  G  M  D  V  I  N  M  S

CCTCGGCGGAGCTTCAGGATCGACCGCGATGAAGCAGGCCGTCGATAAC
 L  G  G  A  S  G  S  T  A  M  K  Q  A  V  D  N

GCCTACGCTAGAGGCGTTGTGGTCGTTGCCGCTGCGGGCAATTCCGGCT
 A  Y  A  R  G  V  V  V  V  A  A  A  G  N  S  G  S

CTTCAGGCAACACCAATACTATCGGCTACCCGGCCAAGTACGACTCTGT
 S  G  N  T  N  T  I  G  Y  P  A  K  Y  D  S  V

GATTGCTGTCGGCGCGGTTGATTCCAACAGCAATCGGGCGTCATTCTCG
 I  A  V  G  A  V  D  S  N  S  N  R  A  S  F  S
```

```
              ...G...
TCCGTTGGAGCTGAGCTCGAGGTCATGGCTCCTGGAGCTGGCGTGTACT
 S   V   G   A   E   L   E   V   M   A   P   G   A   G   V   Y   S

CCACCTACCCCACAAACACGTACGCGACACTTAATGGCACGTCGATGGT
 T   Y   P   T   N   T   Y   A   T   L   N   G   T   S   M   V

TTCCCCACACGTGGCTGGAGCTGCTGCTCTGATCCTCAGCAAGCATCCA
 S   P   H   V   A   G   A   A   A   L   I   L   S   K   H   P

AACCTGTCTGCCTCACAGGTCAGGAATCGCCTCAGCTCTACCGCTACTT
 N   L   S   A   S   Q   V   R   N   R   L   S   S   T   A   T   Y

ACCTTGGCTCATCGTTCTACTACGGCAAGGGCCTCATTAACGTTGAGGC
 L   G   S   S   F   Y   Y   G   K   G   L   I   N   V   E   A

CGCTGCGCAATGA (SEQ ID NO: 41)
 A   A   Q   *  (SEQ ID NO: 12)
```

Amino acid sequence and domain structure of the Q53521 keratinase from *Bacillus licheniformis* PWD-1 (http://www.uniprot.org) shown below includes an amino-terminal signal peptide between amino acid residues 1 to 29 (underlined), the protease inhibitor- or pro-domain between amino acid residues 30 to 105 (italicized), and the catalytic- or protease-domain between amino acid residues 106 to 379 (bolded).

(SEQ ID NO: 12)
MMRKKSFWLGMLTAFMLVFTMAFSDSASAA*QPAKNVEKDYIVGFKSGVKT*

*ASVKKDIIKESGGKVDKQFRIINAAKAKLDKEALKEVKNDPDVAYVEEDH*

*VAHA*LAQTVPYGIPLIKADKVQAQGFKGANVKVAVLDTGIQASHPDLNVV

GGASFVAGEAYNTDGNGHGTHVAGAALDNTTGVLGVAPSVSLYAVKVLNS

SGSGSYSGIVSGIEWATTNGMDVINMSLGSGSTAMKQAVDNAYARGVVVV

AAAGNSGSSGNTNTIGYPAKYDSVIAVGAVDSNSNRSFSSVGAELEVMAP

GAGVYSTYPTNTYATLNGTSMVSPHVAGAAALILSKHPNLSASQVRNRLS

STATYLGSSFYYGKGLINVEAAAQ*

To express the pro-enzyme, the first 29 amino acid residue signal peptide was removed, and a first methionine was added to the N-terminus to generate the pro-Q53521. The codon optimized pro-Q53521 gene was cloned under the control of the strong endosperm specific promoters rice Glutelin B-4, or the maize 27 kDa γ-zein (Z27) promoter, with and without the endoplasmic reticulum retention signal (SEKDEL). To improve expression, intron containing 5'UTR sequences were tested from the maize sucrose synthase gene (SS1), maize alcohol dehydrogenase gene (Adh1) and the maize ubiquitin 1 gene (Ubi1). Altogether 12 expression cassettes were made (Table2): four with the rice glutelin B-4 promoter: pAG2209 (SEQ ID NO: 44), pAG2210 (SEQ ID NO: 45), pAG2211 (SEQ ID NO: 46) and pAG 2212 (SEQ ID NO: 47), eight with the maize zein Z27 promoter: pAG2216 (SEQ ID NO: 48), pAG 2217 (SEQ ID NO: 49), pAG2218 (SEQ ID NO: 50), pAG2219 (SEQ ID NO: 51), pAG2220 (SEQ ID NO: 52), pAG2221 (SEQ ID NO: 53), pAG2222 (SEQ ID NO: 54) and pAG2223 (SEQ ID NO: 55), respectively. Expression cassettes were cloned into KpnI-AvrII sites of the basic transformation vector pAG2005 (SEQ ID NO: 56) that carries a spectinomycin resistance marker, a bacterial origin of replication, an *Agrobacterium* T-DNA borders right (RB), and left (LB). Between the RB and LB is a multicloning site (MCS) and a plant selectable marker comprised of a rice Ubi3 promoter (OsUbi3P), the phosphomannose isomerase coding sequence, and Nos terminator; this plasmid also carries an added rice Ubi3 promoter (OsUbi3P) and Nos terminator in the MCS, between which additional coding sequences may be added.

TABLE 2

List of plant expression cassettes and genetic elements of the expression cassettes

| Vector | SEQ ID NO. | Plant Expression Cassette |
|---|---|---|
| pAG2209 | 44 | Glutelin B-4 promoter:Glutelin B-4 signal peptide (1st connection):pro-Q53521:Nos T |
| pAG2210 | 45 | Glutelin B-4 promoter:Glutelin B-4 signal peptide (1st connection):pro-Q53521:SEKDEL:Nos T |
| pAG2211 | 46 | Glutelin B-4 promoter:Glutelin B-4 signal peptide (2nd connection):pro-Q53521:Nos T |
| pAG2212 | 47 | Glutelin B-4 promoter:Glutelin B-4 signal peptide (2nd connection):pro-Q53521:SEKDEL:Nos T |
| pAG2216 | 48 | maize zein Z27 promoter:maize sucrose synthase gene (SS1) intron:Z27 signal sequence:pro-Q53521:Nos T |
| pAG2217 | 49 | maize zein Z27 promoter:maize maize alcohol dehydrogenase gene (Adh1) intron:Z27 signal sequence:pro-Q53521:Nos T |
| pAG2218 | 50 | maize zein Z27 promoter:maize ubiquitin 1 gene (Ubi1) intron:Z27 signal sequence:pro-Q53521:Nos T |
| pAG2219 | 51 | maize zein Z27 promoter:maize sucrose synthase gene (SS1) intron:Z27 signal sequence:pro-Q53521:Nos T |
| pAG2220 | 52 | maize zein Z27 promoter:maize alcohol dehydrogenase gene (Adh1) intron:Z27 signal sequence:pro-Q53521:SEKDEL:Nos T |
| pAG2221 | 53 | maize zein Z27 promoter:maize ubiquitin 1 gene (Ubi1) intron:Z27 signal sequence:pro-Q53521:SEKDEL:Nos T |
| pAG2222 | 54 | maize zein Z27 promoter:Z27 signal sequence:pro-Q53521:Nos T |
| pAG2223 | 55 | maize zein Z27 promoter:Z27 signal sequence:pro-Q53521:SEKDEL:Nos T |

The *Agrobacterium tumefaciens* superbinary vector system was used for plant transformation as described previously (Komari et al., 2006). The expression cassette was cloned between the T-DNA borders of the pSB11 vector (Japan Tobacco) that carries the plant selectable PMI expression cassette (Privalle, 2002). Each cassette was sequence validated prior to transformation. The pSB11 vector carrying the plant expression cassette within the T-DNA borders was introduced into *Agrobacterium tumefaciens* LBA4404 harboring pSB1 to generate the co-integrate superbinary vector for transformation. Transformation of corn immature embryo was performed according to Japan Tobacco protocol (Ishida et al., 1996, 2007).

Five expression cassettes were introduced into respective pAG2209, pAG2210, pAG2212, pAG2216 and pAG2217 vectors, transformed into corn, and resulted in transgenic events. Events were validated by genotyping of an internal fragment of the PMI selectable marker and of the pro-Q53521.

T0 plants showed normal growth and development and were fertile. Transgenic plants (T0) were reciprocally crossed to A×B wild-type corn plants, and T1 seeds were harvested. Variable seed setting and seed weight was observed in the progeny, but no indication was found that variation was caused by the transgene expression. Transgenic events were used either as the pollen donors (male), or the pollen acceptors (female). Crosses in which the transgenic events were used as pollen donors (male) generally performed better. Table 3 shows vector events with numbers of T1 seeds and total seed weight. In this table, the column with the heading "Vector_event" includes the number of the vector that was used to produce the event, and the number assigned to the transgenic event. For example, number 2209_6 in the column indicates that a transgenic event was created using the vector pAG2209 and it was the event so made that was numbered 6.

TABLE 3

Top five Q53521 transgenic events of each vector ranked by T1 seed yield.

| Vector_event | Expression cassette | Seed weight (g) | Number of seed | Cross type |
|---|---|---|---|---|
| 2209_6 | GlutB:GluB-4:Q53521 | 59.60 | 298 | male |
| 2209_7 | GlutB:GluB-4:Q53521 | 55.60 | 287 | male |
| 2212_19 | GlutB:GluB-4:Q53521:SEKDEL | 52.20 | 361 | male |
| 2212_14 | GlutB:GluB-4:Q53521:SEKDEL | 49.70 | 302 | male |
| 2209_2 | GlutB:GluB-4:Q53521 | 49.30 | 277 | male |
| 2210_11 | GlutB:GluB-4:Q53521:SEKDEL | 48.10 | 229 | male |
| 2212_15 | GlutB:GluB-4:Q53521:SEKDEL | 45.00 | 297 | male |
| 2209_9 | GlutB:GluB-4:Q53521 | 44.90 | 411 | male |
| 2209_11 | GlutB:GluB-4:Q53521 | 43.90 | 387 | male |
| 2212_4 | GlutB:GluB-4:Q53521:SEKDEL | 43.20 | 228 | male |
| 2210_3 | GlutB:GluB-4:Q53521:SEKDEL | 42.70 | 261 | male |
| 2212_23 | GlutB:GluB-4:Q53521:SEKDEL | 42.60 | 321 | male |
| 2210_5 | GlutB:GluB-4:Q53521:SEKDEL | 38.70 | 289 | female |
| 2217_107 | mZein:AdhI:mZ27:Q53521 | 38.40 | 285 | male |
| 2210_5 | GlutB:GluB-4:Q53521:SEKDEL | 36.70 | 328 | male |
| 2217_110 | mZein:AdhI:mZ27:Q53521 | 32.30 | 203 | male |
| 2210_17 | GlutB:GluB-4:Q53521:SEKDEL | 29.70 | 287 | male |
| 2217_103 | mZein:AdhI:mZ27:Q53521 | 27.60 | 168 | male |
| 2216_5 | mZein:mSSI:mZ27:Q53521 | 24.50 | 210 | male |
| 2217_108 | mZein:AdhI:mZ27:Q53521 | 19.30 | 142 | male |
| 2217_104 | mZein:AdhI:mZ27:Q53521 | 17.90 | 216 | male |
| 2216_1 | mZein:mSSI:mZ27:Q53521 | 10.10 | 150 | male |
| 2216_4 | mZein:mSSI:mZ27:Q53521 | 5.30 | 37 | female |
| 2216_5 | mZein:mSSI:mZ27:Q53521 | 0.10 | 1 | female |

A sampling procedure was established that allowed transgenic genotyping and testing the keratinase activity in dry seed endosperm while preserving seed viability. For sampling, seeds were split in half. Parts of the seeds that contained embryos were preserved and the other parts were tested. Parts of the seeds without embryos were ground to produce a fine powder. 10-30 mg of seed powder was resuspended in a buffer containing 100 mM sodium phosphate (pH 7.5), 0.5 mM EDTA and 0.5% Triton X-100, placed in deep-well extraction block containing a 4 mm steel ball and subjected to extraction by shaking at maximal power for 45 seconds at room temperature in a Klecko homogenizer. The block was centrifuged at 3000×g for 15 min and the clear supernatant was recovered. Protein was assayed using the Bradford method and keratinase activity was assayed using keratin-azure. Seeds were screened for the presence of transgenes using genotyping of an internal fragment of Q53521 and the selectable marker PMI.

A protease assay was set up according to Bressollier et al. (1999) using duplicate assays. Mechanically ground seed samples were incubated with 4 mg of keratin azure as a substrate (Sigma Aldrich) in 1 ml of 50 mM Tris-HCl buffer (pH 7.5) at 50° C. for 3 h with constant agitation at 200 rpm. From each event, five T1 seeds were assayed. One unit of the protease activity was defined as the amount of enzyme that resulted in an increase of absorbance at 595 nm (A595) of 0.01 U after reaction with keratin azure for 1 h. Trypsin was used to estimate the background activity. FIG. 1 demonstrates that the enzyme activity was confirmed in at least one progeny from each event and that duplicates differ only by ≤10%. No activity was detectable in the A×B control and in the trypsin control. These results are consistent with expression of functionally active keratinase from the pAG2209 cassette.

Example 3. Alternative Strategies to Produce Keratinase: Express Keratinase in Two Inactive Parts, then Use Trans-Splicing Inteins to Promote Formation of a Functional Protease In developing a successful trans-splicing protease, solubility of both parts of the intein-modified exteins is beneficial for the association of the two components and efficient splicing (Yamazaki, T., et al., 1998, Otomo et al., 1999). Similar to cis splicing, trans-splicing is context dependent, and may require additional intein flanking residues added at the insertion site.

A trans-splicing intein that may be in an intein-modified protease or implemented in a method herein is from *Synechocystis* sp. PCC6803, called the Ssp DnaE trans-splicing intein. In the *Synechocystis* sp. (Ssp) PCC6803, the replicative DNA polymerase gene catalytic subunit is encoded by two open reading frames over 700 kb apart on the opposite strands of the chromosome. The functional protein is assembled post-translationally from these two parts by the trans-splicing Ssp DnaE intein. This two-part intein could be exploited for assembly of heterologusly expressed, split intein-modified proteases and other proteins.

Examples of assembly of functional proteins from their inactive parts in plants include: reconstruction from two parts of a functional beta-glucuronidase gene (GUS) in *Arabidopsis* (Yang J. et al, 2003), engineering glyphosate herbicide resistance from split gene of the 5-enolpyruvyl-shikimate-3-phosphate synthase (EPSPS) (Chin, H G et al., 2003), or reconstitution of sulphonylurea resistance by DnaE intein-mediated assembly of the acetolactate synthase (ALS) protein from rice (Kempe et al. 2009). The cytotoxic barnase was also expressed into two inactive parts and reassembled to active protein by trans-splicing of the Ssp DnaB intein (Kempe et al., 2009). However, proteases have never been regulated, or assembled, using either cis- or trans-splicing inteins. Unlike other enzymes that have been produced through trans-splicing, proteases have distinct applications and may become active under different conditions than the other mentioned proteins, where spontaneous splicing was more desirable than regulated splicing. If protease splicing occurs inside the host spontaneously, then the effect of the protease on the host would not be different from expressing the fully active protein, which is often detrimental to host growth and development. In contrast, for intein-modified EPSPS and ALS proteins, in order to provide herbicide tolerance to the host plant it is important to become active through spontaneous splicing. Thus the benefit of EPSPS and ALS is to the plant host, whereas the benefit of the protease is not to the expression host, but in subsequent uses of the protease enzyme, such as animal feed or laundry detergents.

Example 4. Intein Insertion Site Selection in Q53521

To engineer the Q53521 protease with an intein, molecular modeling was used to identify intein insertion sites within the Q53521 protease. Three different methods were used to select sites for intein insertion.

1) The first method was based on the requirement of the protease inhibitor pro-domain for active folding of the protease domain. Splitting the enzyme between these two domains could render the catalytic domain inactive until the enzyme is spliced together and refolded. One site for this is the T108 site which lies between the domains.

2) The second method used was to identify sites in surface exposed positions, near the end of secondary structures, or between catalytic residues (D137, H168, S325) but close to the end of the domain. These criteria were selected so that intein insertion within the enzyme would separate the active site residues but still allow for the most native like contacts to partially facilitate pre-splicing folding of the protein. The sites were selected using the crystal structure 1yu6 chain A. These were S154 and T317.

3) Finally sites were selected that gave the highest SVM splicing cassette prediction score, and that were in-between the catalytic residues. See James Apgar, Mary Ross, Xiao Zuo, Sarah Dohle, Derek Sturtevant, Binzhang Shen, Humberto dela Vega, Phillip Lessard, Gabor Lazar, R. Michael Raab, "Predictive Model of Intein Insertion Site for Use in the Engineering of Molecular Switches," PLoS ONE, 7(5): e37355, 2012; DOI:10,1371/journal,pone,0037355 and U.S. patent application Ser. No. 12/590,444, filed Nov. 6, 2009, all of which are incorporated by reference herein as if fully set forth. These sites were S234, S260 and S263. Other insertion sites were also attempted.

Example 5. Intein Selection

The *Synechocystis* sp. PCC6803 DnaE trans-splicing intein was chosen to construct intein-modified exteins of Q53521. Nucleotide and amino acid sequences of the Ssp DnaE intein N- and C-terminal parts were corn codon optimized for plant expression. The N- and C-terminal parts of the intein were joined, and Ssp DnaE was synthesized as a single open reading frame (Codon Devices Inc.). An internal XhoI site was removed by site directed silent mutation converting the sequences ctcgag to ctggag. Nucleotide sequence of Ssp DnaE N with ctggag sequence underlined is as follows:

(SEQ ID NO: 42)
tgcctttattcggaactgagatccttaccgttgagtacggaccacttcct attggtaagatcgtttctgaggaaattaactgctcagtgtactctgttga tccagaaggaagagtttacactcaggctatcgcacaatggcacgatagggg gtgaacaagaggtt<u>ctggag</u>tacgagcttgaagatggatccgttattcgt gctacctctgaccatagattcttgactacagattatcagcttctcgctat cgaggaaatctttgctaggcaacttgatctccttactttggagaacatca agcagacagaagaggctcttgacaaccacagacttccattccattgctcg atgctggaaccatcaag Nucleotide sequence of Ssp DnaE C:

(SEQ ID NO: 43)
tggttaaggtgattggaagacgttctcttggtgttcaaaggatcttcgat atcggattgccacaagaccacaactttcttctcgctaatggtgccatcgc tgccaat Amino acid sequence of Ssp DnaE N:

(SEQ ID NO: 38)
CLSFGTEILTVEYGPLPIGKIVSEEINCSVYSVDPEGRVYTQAIAQWHDR

GEQEVLEYELEDGSVIRATSDHRFLTTDYQLLAIEEIFARQLDLLTLENI

KQTEEALDNHRLPFPLLDAGTIK

Amino acid sequence of Ssp DnaE C:

(SEQ ID NO: 39)
MVKVIGRRSLGVQRIFDIGLPQDHNFLLANGAIAAN

Example 6. Expression of Pro-Q53521 Proenzyme from Lambda Phage. Construction and Expression of Trans-Splicing Pairs of Pro-Q53521-DnaE-N and DnaE-C-Q53 from Lamba Phage To examine whether trans-splicing is feasible, six pairs of expression cassettes for co-expression in *E. coli* were made. The N-terminal domain of Q53521 was fused covalently with the N-terminal half of the DnaE split intein (NI). The C-terminal half of the DnaE was fused to the C-terminal half of Q53521 (IC).

The lambda phage was used to express intein-modified enzymes in phage plaques and to screen for trans-splicing regulated enzyme activity on diagnostic agar plates. These plates contain a colorimetric substrate that turns blue in the the presence of active protease. This system was adopted to express pro-Q53521. In addition, the trans-splicing NI and IC extein pairs of Q53521-DnaE were expressed in phage plaques and phage lysates, protein expression was monitored on SDS/PAGE, and restoration of protease activity was tested in vitro on protease diagnostic plates.

An internal XhoI site was eliminated from the corn codon optimized Q53521 and the pro-enzyme pro-Q53521 was cloned into the EcoRI and XhoI sites of the bicistronic expression cassette of the lambda Uni ZAP XR (Agilent).

Protease diagnostic plates were set up to detect activity of phage expressed pro-Q53521. NZY top agar (Stratagene manual for Uni ZAP XR) was supplemented with IPTG (2.5 mM) and 0.5% AZCL-casein (Megazyme). Plates were incubated overnight at 37° C. till confluent lysis, and incubated further at 50° C. for 6 hrs.

Protease diagnostic, gel diffusion assay plates (Sokol et al., 1979) were set up according to Zhao et al (2004), but with casein substituted with 0.4% AZCL-casein (Megazyme) to improve detection sensitivity. Protease activity was validated with commercial *B. lycheniformis* protease (Sigma-P8038). Development of blue color showed protease activity. Detection sensitivity was 30 ng protease in 90 min at 37° C. Negative control empty vector showed no blue color development.

The trans-splicing Ssp. DnaE intein was inserted into pro-Q53521 at six sites: T108, S154, S234, S260, S263 and T317. At each site two constructs were generated for a split Q53-DnaE NI and IC. Constructs were generated by overlapping PCR and cloned into the bicistronic cassette downstream to the lac promoter into the EcoRI/XhoI sites of the lambda Uni ZAP vector. Recombinant lambda DNA was packaged to phage, and handled according to standard procedures (Uni ZAP XR, Stratagene manual), but plating was made to protease diagnostic plates.

Amino acid sequences of six trans splicing pairs of Q53:DnaE are listed in trans splicing NI-(1-6) and IC-(1-6) pairs. The pro-Q53521 was separated to N and C fragments at six sites: T108, S154, S234, S260, S263 and T317. The Q53 N-fragment was fused in frame with the Ssp DnaE-N to generate NI, the DnaE-C was fused in frame with the Q53-C fragment to generate IC. The Ssp DnaE part of the sequences are underlined and in bold typeface. Molecular weight was calculated using the Compute pI/Mw tool at www.expasy.org.

NI-1 Q53521-T108:DnaE-N(22.61 Kd) (SEQ ID NO: 13):

MAQPAKNVEKDYIVGFKSGVKTASVKKDIIKESGGKVDKQFRIINAA
KAKLDKEALKEVKNDPDVAYVEEDHVAHALAQ C L S F G T E I L
T V E Y G P L P I G K I V S E E I N C S V Y S V D
P E G R V Y T Q A I A Q W H D R G E Q E V L E Y E
L E D G S V I R A T S D H R F L T T D Y Q L L A I
E E I F A R Q L D L L T L E N I K Q T E E A L D N
H R L P F P L L D A G T I K *

IC-1 DnaE-C:T108-Q53521-C(31.1 Kd) (SEQ ID NO: 14):

M V K V I G R R S L G V Q R I F D I G L P Q D H N
F L L A N G A I A A NCTVPYGIPLIKADKVQAQGFKGANVKVAV
LDTGIQASHPDLNVVGGASFVAGEAYNTDGNGHGTHVAGTVAALDNTTGV
LGVAPSVSLYAVKVLNSSGSGSYSGIVSGIEWATTNGMDVINMSLGGASG
STAMKQAVDNAYARGVVVVAAAGNSGSSGNTNTIGYPAKYDSVIAVGAVD
SNSNRASFSSVGAELEVMAPGAGVYSTYPTNTYATLNGTSMVSPHVAGAA
ALILSKHPNLSASQVRNRLSSTATYLGSSFYYGKGLINVEAAAQ*

NI-2 Q53521-S154:DnaE-N(27.25 Kd) (SEQ ID NO: 15):

MAQPAKNVEKDYIVGFKSGVKTASVKKDIIKESGGKVDKQFRIINAA
KAKLDKEALKEVKNDPDVAYVEEDHVAHALAQTVPYGIPLIKADKVQAQG
FKGANVKVAVLDTGIQASHPDLNVVGGA C L S F G T E I L T V
E Y G P L P I G K I V S E E I N C S V Y S V D P E
G R V Y T Q A I A Q W H D R G E Q E V L E Y E L E
D G S V I R A T S D H R F L T T D Y Q L L A I E E
I F A R Q L D L L T L E N I K Q T E E A L D N H R
L P F P L L D A G T I K *

IC-2 DnaE-C:S154-Q53521-C(26.46 Kd) (SEQ ID NO: 16):

M V K V I G R R S L G V Q R I F D I G L P Q D H N
F L L A N G A I A A NCSFVAGEAYNTDGNGHGTHVAGTVAALDN
TTGVLGVAPSVSLYAVKVLNSSGSGSYSGIVSGIEWATTNGMDVINMSLG
GASGSTAMKQAVDNAYARGVVVVAAAGNSGSSGNTNTIGYPAKYDSVIAV
GAVDSNSNRASFSSVGAELEVMAPGAGVYSTYPTNTYATLNGTSMVSPHV
AGAAALILSKHPNLSASQVRNRLSSTATYLGSSFYYGKGLINVEAAAQ*

NI-3 Q52521-S234:DnaE-N(35.04 Kd) (SEQ ID NO: 17):

MAQPAKNVEKDYIVGFKSGVKTASVKKDIIKESGGKVDKQFRIINAA
KAKLDKEALKEVKNDPDVAYVEEDHVAHALAQTVPYGIPLIKADKVQAQG
FKGANVKVAVLDTGIQASHPDLNVVGGASFVAGEAYNTDGNGHGTHVAGT
VAALDNTTGVLGVAPSVSLYAVKVLNSSGSGSYSGIVSGIEWATTNGMDV
INMSLGGA C L S F G T E I L T V E Y G P L P I G K I
V S E E I N C S V Y S V D P E G R V Y T Q A I A Q
W H D R G E Q E V L E Y E L E D G S V I R A T S D
H R F L T T D Y Q L L A I E E I F A R Q L D L L T
L E N I K Q T E E A L D N H R L P F P L L D A G T
I K *

IC-3 DnaE-C:S234-Q53521-C(18.68 Kd) (SEQ ID NO: 18):

<u>MVKVIGRRSLGVQRIFDIGLPQDHN</u>

<u>FLLANGAIAA NC</u>SGSTAMKQAVDNAYARGVVVVAAAGNSG

SSGNTNTIGYPAKYDSVIAVGAVDSNSNRASFSSVGAELEVMAPGAGVYS

TYPTNTYATLNGTSMVSPHVAGAAALILSKHPNLSASQVRNRLSSTATYL

GSSFYYGKGLINVEAAAQ*

NI-4 Q53521-S260:DnaE-N(37.53 Kd) (SEQ ID NO: 19):

MAQPAKNVEKDYIVGFKSGVKTASVKKDIIKESGGKVDKQFRIINA

AKAKLDKEALKEVKNDPDVAYVEEDHVAHALAQTVPYGIPLIKADKVQAQ

GFKGANVKVAVLDTGIQASHPDLNVVGGASFVAGEAYNTDGNGHGTHVAG

TVAALDNTTGVLGVAPSVSLYAVKVLNSSGSGSYSGIVSGIEWATTNGMD

VINMSLGGASGSTAMKQAVDNAYARGVVVVAAAGN <u>CLSFGTE</u>

<u>ILTVEYGPLPIGKIVSEEINCSVYS</u>

<u>VDPEGRVYTQAIAQWHDRGEQEVLE</u>

<u>YELEDGSVIRATSDHRFLTTDYQLL</u>

<u>AIEEIFARQLDLLTLENIKQTEEAL</u>

<u>DNHRLPFPLLDAGTIK</u> *

IC-4 DnaE-C:S260-Q53521-C(16.19 Kd) (SEQ ID NO: 20):

<u>MVKVIGRRSLGVQRIFDIGLPQDHN</u>

<u>FLLANGAIAA NC</u>SGSSGNTNTIGYPAKYDSVIAVGAVDSN

SNRASFSSVGAELEVMAPGAGVYSTYPTNTYATLNGTSMVSPHVAGAAAL

ILSKHPNLSASQVRNRLSSTATYLGSSFYYGKGLINVEAAAQ*

NI-5 Q53521-S263-DnaE-N(37.76 Kd) (SEQ ID NO: 21):

MAQPAKNVEKDYIVGFKSGVKTASVKKDIIKESGGKVDKQFRIINA

AKAKLDKEALKEVKNDPDVAYVEEDHVAHALAQTVPYGIPLIKADKVQAQ

GFKGANVKVAVLDTGIQASHPDLNVVGGASFVAGEAYNTDGNGHGTHVAG

TVAALDNTTGVLGVAPSVSLYAVKVLNSSGSGSYSGIVSGIEWATTNGMD

VINMSLGGASGSTAMKQAVDNAYARGVVVVAAAGNSGS <u>CLSFGT</u>

<u>EILTVEYGPLPIGKIVSEEINCSVY</u>

<u>SVDPEGRVYTQAIAQWHDRGEQEVL</u>

<u>EYELEDGSVIRATSDHRFLTTDYQL</u>

<u>LAIEEIFARQLDLLTLENIKQTEEA</u>

<u>LDNHRLPFPLLDAGTIK</u> *

IC-5 DnaE-C:S263-Q53521-C(15.95 Kd) (SEQ ID NO: 22):

<u>MVKVIGRRSLGVQRIFDIGLPQDHN</u>

<u>FLLANGAIAA NC</u>SGNTNTIGYPAKYDSVIAVGAVDSNSNR

ASFSSVGAELEVMAPGAGVYSTYPTNTYATLNGTSMVSPHVAGAAALILS

KHPNLSASQVRNRLSSTATYLGSSFYYGKGLINVEAAAQ*

NI-6 Q53521-T317:DnaE-N(43.20 Kd) (SEQ ID NO: 23):

MAQPAKNVEKDYIVGFKSGVKTASVKKDIIKESGGKVDKQFRIINA

AKAKLDKEALKEVKNDPDVAYVEEDHVAHALAQTVPYGIPLIKADKVQAQ

GFKGANVKVAVLDTGIQASHPDLNVVGGASFVAGEAYNTDGNGHGTHVAG

TVAALDNTTGVLGVAPSVSLYAVKVLNSSGSGSYSGIVSGIEWATTNGMD

VINMSLGGASGSTAMKQAVDNAYARGVVVVAAAGNSGSSGNTNTIGYPAK

YDSVIAVGAVDSNSNRASFSSVGAELEVMAPGAGVYSTYPTN <u>CLSF</u>

<u>GTEILTVEYGPLPIGKIVSEEINCS</u>

<u>VYSVDPEGRVYTQAIAQWHDRGEQE</u>

<u>VLEYELEDGSVIRATSDHRFLTTDY</u>

<u>QLLAIEEIFARQLDLLTLENIKQTE</u>

<u>EALDNHRLPFPLLDAGTIK</u> *

IC-6 DnaE-C:T317-Q53521-C(10.51 Kd) (SEQ ID NO: 24):

<u>MVKVIGRRSLGVQRIFDIGLPQDHN</u>

<u>FLLANGAIAA NC</u>TYATLNGTSMVSPHVAGAAALILSKHPN

LSASQVRNRLSSTATYLGSSFYYGKGLINVEAAAQ*

Protease activity of phage expressed pro-Q53521 was tested using protease diagnostic plates. Trans-splicing was tested in sandwich plating of protease diagnostic plates of bacterial hosts infected with the NI and IC trans splicing pairs.

Example 7. Expression of Pro-Q53521 in *E. coli*

Expression of pro-Q53521 in *E. coli* was performed according to the protocol of Tiwary and Gupta (2010), and evaluated for trans-splicing activity of Q53521-DnaE NI and IC pairs co-expressed from pETDuet-1 vector in *E. coli*.

Two protease assays were set up: the AZO-casein protocol according to Radha and Gunasekaran (2008) and the QuantiCleave protease assay from Pierce (1992).

Pro-Q53521 was cloned with and without a C-terminal 6×His tag into the XbaI and XhoI sites of the pET30b(+) vector (Novagen), and the pro-keratinase was expressed in BL21(DE3)pLysS cells (*E. coli*). Starter culture was inoculated to induction culture (4% v/v) into LB medium supplemented with 50 mg/L kanamycin and incubated at 37° C., 300 rpm to $OD_{600}$ 0.8. Isopropylthiogalactoside (IPTG) was added to 0.1 mM final conc. and cultures were grown for another 180 min. Aliquots were taken at time points 0, 30, 60, 90, 120 and 180 minutes. The 180 min aliquot was separated to soluble (S) and nonsoluble (P) fractions: cells were harvested, lysed in 50 mM Tris pH7.5 supplemented with 1× Fastbreak (Promega) and 0.02 µl/ml Benzonase (Novagen) at room temperature for 30 min. Lysate was pelleted at 13K/10 min. Supernatant is the soluble (S), pellet is the nonsoluble fraction (P). Pro-keratinase accumulated in the nonsoluble fraction. IPTG-inducible pro-Q53521 was readily identified on Coomassie stained SDS/PAGE of total proteins.

Alternative bacterial hosts: C3030H, Origami 2 (DE3) pLysS, BL21(DE3), BL21star(DE3)pLysS were tested with the same expression vector pET30b(+) for pro-Q53521. IPTG induced accumulation of pro-Q53521 was readily detectable in BL21(DE3), C3030 and BL21(DE3)pLysS. Induction cultures were inoculated from starter cultures (5% v/v) and grown in LB medium supplemented with the approporiate antibioticums at 25° C., 300 rpm to $OD_{600}$~0.7. IPTG was added to 0.1 mM final conc. 0, 90 and 180 minutes aliquots were separated on Criterion XT 12% Bis-Tris SDS/PAGE and Coomassie stained with Simply Blue Safe Stain. The 0 and 90 min samples are 1:1 mixes of the whole culture aliquots with 2×SDS loading dye. The 180 min aliquots were processed to soluble and non-soluble fraction: cells were harvested, lysed in 50 mM Tris pH7.5 supplemented with 1× Fastbreak (Promega) and 0.02 µl/mL Benzonase (Novagen) at room temperature for 30 min. Lysate was pelleted at 13K for 10 min. Supernatant is the soluble, pellet is the insoluble fraction. Expression was supported by three hosts: BL21(DE3), BL21(DE3)pLysS and C3030H, but keratinase accumulated into the insoluble fraction in each host.

To improve the assay, the traditional *E. coli* based expression will be switched to expression in alternative hosts. For example, *Bacillus subtilis* and/or *Pichia pastoris* can be used since both organisms are known to support production of the functional keratinase of the *B. licheniformis* PWD-1 (Lin et al. 1997, Wang and Shih 1999, Wang et al. 2003, Wang et al. 2004, Porres et al, 2002). *B. subtilis* expression is also attractive because of its excellent secretion ability, fast growth, easy handling and because it is a nonpathogenic bacterium, free of endotoxin (Yeh et al., 2007).

Example 8. Conditionally Regulated Proteases for the Laundry Detergent Industry A major problem in the laundry industry is the instability of enzymes in detergents during storage. The stability problem of the detergent enzymes is primarily due in part to detergent protease activity that can digest itself and other detergent enzymes including proteases, lipases, amylases, cellulases, mannanases, xylanases, and others.

Development of detergent proteases with regulated activity that have no activity in the formulation mixture but can be activated during the wash cycle by dilution of the detergent, exposure to cold water, or by various other means is an attractive goal. For a detergent protease, the subtilase Savinase, a subtilisin family alkaline protease, was intein-modified; however, this technique is applicable to other subtilases (Siezen et al. 1997) which constitute an important class of proteases used by the detergent industry. Savinase (EC 3.4.21.62) from *Bacillus lentus* has been variably described as AprB peptidase (*Bacillus* sp. B001), Esperase, Maxacal, protease PB92 (*Bacillus* sp.), Savinase, Savinase Ultra, Savinase Ultra 16L, subtilisin 309, subtilisin (*Bacillus lentus* variant), subtilisin BL or subtilisin MC3. Amino acid sequences of the Savinase and representative set of subtilisins includes sequences of SEQ ID NOS: 1-12.

A strategy to regulate Savinase is based on the intein technology. Initially, it was desired to develop an intein-modified protease that is induced by cold splicing and/or induced by dilution of the detergent. For detergent enzyme development both cis and trans splicing inteins may be equally useful.

Example 9. Protease Expression in *E. coli* System

Expression of the Secreted Savinase in *Bacillus subtilis* WB800N

Nucleotide sequences encoding the subtilisin preproSavinase, pro Savinase and the Savinase catalytic domain of the Savinase P29600 (UniProt) were synthesized and cloned into pUC57 (GenScript) plasmid. In the amino acid sequences below the signal peptide (residues 1-22) at the N-terminus is marked in bold, the pro-domain is underlined, and the 269 amino acids of the catalytic domain are unmarked.

The sequence of pre-pro Savinase, including the pre-signal peptide for secretion, is (SEQ ID NO: 1):

MKKPLGKIVASTALLISVAFSSSIASA<u>AEEAKEKYLIGFNEQEAVSEFVE</u>

<u>QVEANDEVAILSEEEEVEIELLHEFETIPVLSVELSPEDVDALELDPAIS</u>

<u>YIEEDAEVTTM</u>AQSVPWGISRVQAPAAHNRGLTGSGVKVAVLDTGISTHP

DLNIRGGASFVPGEPSTQDGNGHGTHVAGTIAALNNSIGVLGVAPSAELY

AVKVLGASGSGSVSSIAQGLEWAGNNGMHVANLSLGSPSPSATLEQAVNS

ATSRGVLVVAASGNSGAGSISYPARYANAMAVGATDQNNNRASFSQYGAG

LDIVAPGVNVQSTYPGSTYASLNGTSMATPHVAGAAALVKQKNPSWSNVQ

IRNHLKNTATSLGSTNLYGSGLVNAEAATR.

The sequence of pro-Savinase, including pro-peptide for maturation, is (SEQ ID NO 57):

<u>M</u>AEEAKEKYLIGFNEQEAVSEFVEQVEANDEVAILSEEEEVE

IELLHEFETIPVLSVELSPEDVDALELDPAISYIEEDAEVTTMAQSVPWG

ISRVQAPAAHNRGLTGSGVKVAVLDTGISTHPDLNIRGGASFVPGEPSTQ

DGNGHGTHVAGTIAALNNSIGVLGVAPSAELYAVKVLGASGSGSVSSIAQ

GLEWAGNNGMHVANLSLGSPSPSATLEQAVNSATSRGVLVVAASGNSGAG

SISYPARYANAMAVGATDQNNNRASFSQYGAGLDIVAPGVNVQSTYPGST

YASLNGTSMATPHVAGAAALVKQKNPSWSNVQIRNHLKNTATSLGSTNLY

GSGLVNAEAATR.

The sequence of the Savinase catalytic domain is (SEQ ID NO: 58):

<u>M</u>AQSVPWGISRVQAPAAHNRGLTGSGVKVAVLDTGISTHPDLNIRGGA

SFVPGEPSTQDGNGHGTHVAGTIAALNNSIGVLGVAPSAELYAVKVLGA

SGSGSVSSIAQGLEWAGNNGMHVANLSLGSPSPSATLEQAVNSATSRGV

LVVAASGNSGAGSISYPARYANAMAVGATDQNNNRASFSQYGAGLDIVA

PGVNVQSTYPGSTYASLNGTSMATPHVAGAAALVKQKNPSWSNVQIRNH

LKNTATSLGSTNLYGSGLVNAEAATR

To test secreted expression of Savinase in *B. subtilis* the full length protein (pre-pro-Savinase), the pro-Savinase, and the catalytic domain Savinase were cloned between the BamHI and AatII sites of the pHT01 and pHT43 vectors with and without a C-terminal His-tag from MoBiTec. These were expressed in the *B. subtilis* WB800N cells deficient in eight extracellular proteases. Sequences of the resulted constructs are listed in Table 4.

TABLE 4

SEQ ID NOS of nucleotide and amino acid sequences of Savinase expression cassettes in the *B. subtilis* vectors pHT01 and PHT43.

| Construct | Nucleic Acid SEQ ID NO | Amino Acid SEQ ID NO |
|---|---|---|
| pHT01-preproSavinase/P29600 | 59 | 1 |
| pHT01-preproSavinase-8His | 60 | 61 |
| pHT01-proSavinase-8His | 62 | 63 |
| pHT01-Savinase-8His | 64 | 65 |
| pHT43-preproSavinase-8His | 66 | 67 |
| pHT43-proSavinase-8His | 68 | 69 |
| pHT43-Savinase-8His | 70 | 71 | pHT01 is a cytoplasmic expression vector, but secreted expression is possible via the native secretion signal of the full-length Savinase protein. pHT43 is a secretion vector with N-terminal SamyQ secretion signal that directs recombinant proteins into the medium. In the pHT43-preproSav-8His, the SamyQ secretion signal is followed by stop codon and the full-length protein with native secretion signal is expressed from a bicistronic expression cassette. In the pHT43-proSav-8His, the proenzyme is expressed with the vector encoded N-terminal SamyQ secretion signal. *B. subtilis* handling was performed according to MoBiTec protocols except that the transformation was performed according to Lu et al. (2012).

Activity of the secreted Savinase proteins from *B. subtilis* WB800N cells was assayed on LB agar plates supplemented with 10 mM $CaCl_2$, 10 g/mL chloramphenicol, 1 mM IPTG and 0.25% AZCL-casein (Megazyme). Four biological replicates of *B. subtilis* expressing each construct were inoculated to agar plates and incubated overnight at 37° C. Release of blue dye around bacterial growth indicates protease activity. Protease activity was detectable from the preproSavinase with or without an 8×His tag expression cassettes in the pHT01 and pHT43 vectors and from the pHT43-SamyQproSav (without a his-tag) construct where the native secretion signal was replaced by the SamyQ signal peptide.

Figure 2:
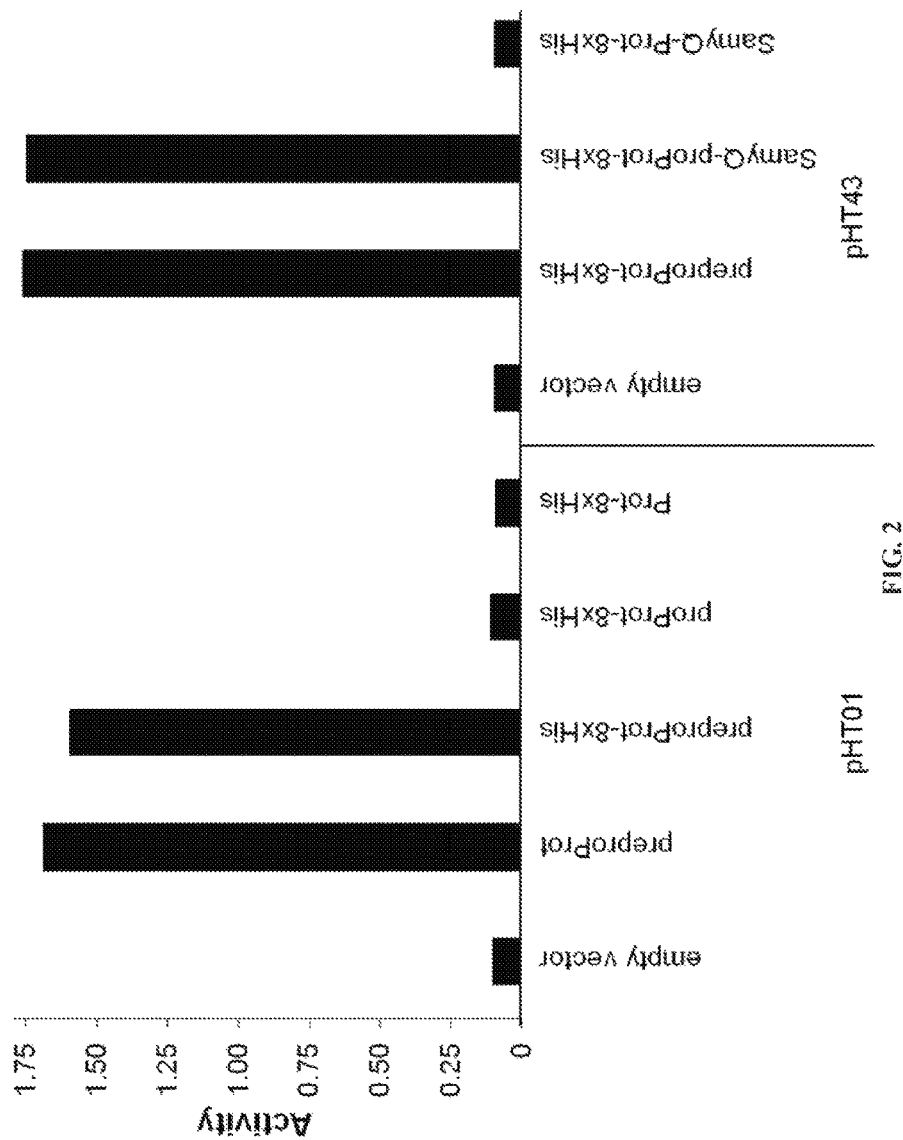
FIG. 2 illustrates protease activity of the secreted Savinase assayed in the *B. subtilis* culture supernatant.

Protease activity of secreted Savinase was assayed in the *B. subtilis* supernatant (FIG. 2). *B. subtilis* cultures were grown overnight at 37° C., 300 rpm in LB medium supplemented with chloramphenicol (10 μg/mL) and IPTG (1 mM). Two-hundred microliters of culture were pelleted for 5 min at 16K RCF, the supernatant was harvested, diluted 1:1 with 0.1 M Tris pH 8, 0.5 mM $CaCl_2$, combined with an equal volume of 1% AZO-casein (Megazyme) in the same buffer and incubated for 30 minutes at 37° C. Proteins were precipitated by addition of equal volume of 5% TCA for 5 min at ambient temperature and the precipitate was pelleted in a micro-centrifuge at 16,000 RFC/5 min. 100 μL of supernatant was combined with 100 μL of NaOH and the absorbance was read at 420 nm. Protease activity was detected in cultures expressing the proSavinase having both its native secretion signal (pHT01) and the SamyQ secretion peptide (pHT43). FIG. 2 shows that Savinase activity was detected in the suspension culture supernatants from the preproSav, with or without 8×His tag, for both expression vectors pHT01 and pHT43, and from the SamyQproSav, without a his-tag, in the pHT43. There was no detectable activity from the pro Savinase in the cytoplasm (pHT01-proSav-His), or when the Savinase catalytic domain was expressed with either the native or the SamyQ secretion signal.

The results were confirmed by Western blot analysis of *B. subtilis* expressing Savinase. Briefly, *B. subtilis* cultures were grown overnight at 37° C., 300 rpm in LB medium supplemented with chloramphenicol (10 μg/mL) and IPTG (1 mM). Two-hundred microliters of culture were pelleted for 5 min at 16 k RCF and the supernatant was removed. The pellet was resuspended in 1/10 original culture volume of 2× Laemmli buffer (BioRad) with 5% β-mercaptoethanol and an equal volume of $H_2O$ was added. The supernatant was combined with equal volumes of 2× Laemmli buffer supplemented with 5% β-mercaptoethanol and both supernatant and pellet samples were boiled for 5 minutes at 95° C. before loading on 12% bis-tris polyacrylamide gel (BioRad) and the gel was run at 150-160V. For Western blot, proteins were transferred to PVDF membrane and the membrane was developed with the primary antibody "THE anti-His" (GenScript) and secondary HRP::goat anti-mouse (Sigma) along with HRP anti-biotin (Cell Signalling Technologies) to visualize the molecular weight markers. The 28 kDa band is the mature Savinase. Secreted proSavinase+8His undergo proper maturation. ProSavinase expressed to the cytoplasm did not undergo maturation (pHT01-proSav-8His). Enzyme activity correlates well with the accumulation in the supernatant of a ~28 kDa protein corresponding to the mature Savinase. Lack of activity may be due to the fact that the proSavinase does not undergo maturation in the cytoplasm (pHT01-ProSav-8His), and that the Savinase catalytic domain is unstable both in the cytoplasm and in the secreted form (pHT01-Sav-8His and pHT43-SamyQSav-8His).

These observations indicate that expression of active Savinase in *B. subtilis* requires secretion of the proSavinase for proper maturation of catalytically active protease.

Expression of Secreted Savinase in *E. coli*

To test whether *E. coli* could be suitable host for secreted expression of Savinase, nucleotide sequences of the pro-Savinase and the Savinase catalytic domain were cloned into the pET22b(+) secretion vector in frame with the N-terminal pelB signal peptide, and the pET22b-pelBproSav-6His and pET22b-pelBSav-6His vectors were created. Vectors were transformed into the BL21(DE3) and Lemo21(DE3) *E. coli* strains. To test Savinase expression, overnight suspension cultures were pelleted and cells were fractionated to periplasmic and spheroplastic fractions using the Peripreps Periplasting kit from Epicentre Biotechnologies (PS81100).

Samples were analyzed by Western blot and assayed for protease activity (FIGS. 3 and 4).

Figures 3A, 3B:
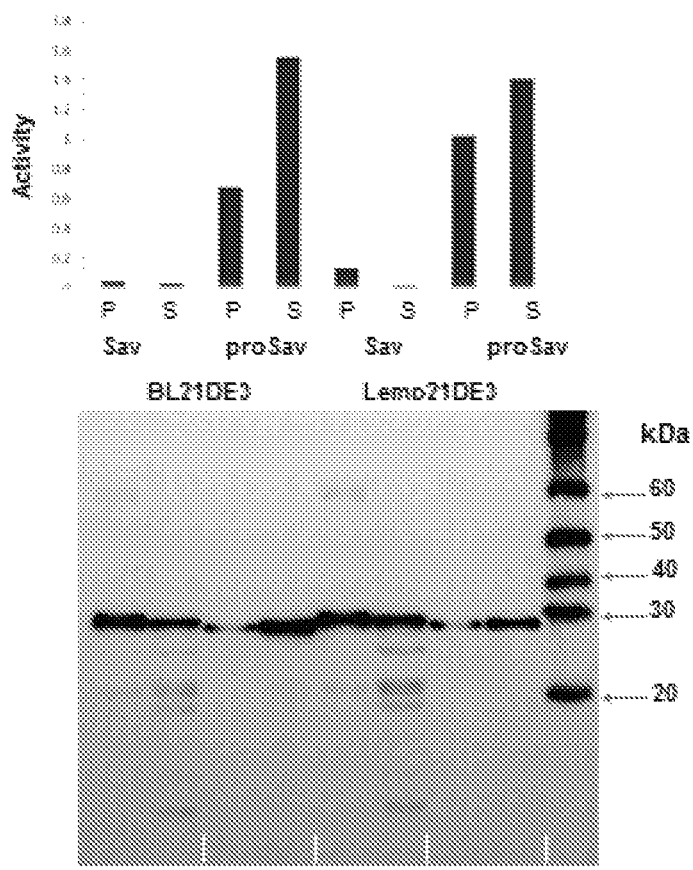
FIG. 3A illustrates protease activity of the pro-Savinase and the Savinase catalytic domain expressed in the periplasm (P) and spheroplast (S) of *E. coli*.
FIG. 3B illustrates Western blot analysis of the expression of the pro-Savinase and the Savinase catalytic domain in the periplasm (P) and spheroplast (S) of *E. coli*.

Briefly, nucleotide sequences encoding the Savinase catalytic domain and the pro-Savinase were cloned into the pET22b(+) secretion vector in frame with the N terminal pelB signal peptide creating the pET22b-pelBSav-6His and pET22b-pelB-proSav-6His. Vectors were transformed into the BL21(DE3) and Lemo21(DE3) *E. coli* strains and suspension cultures were grown in Overnight Express Instant TB Medium (AIM, Novagen) supplemented with carbenicillin 100 mg/L, at 30° C./300 rpm/overnight. One milliliter aliquots aliquots were used to prepare the periplasmic (P) and spheroplastic (S) fractions using the Peripreps Periplasting kit from Epicentre Biotechnologies (PS81100). For the Western blot analysis (FIG. 3B), 5 µL of the periplasmic and spheroplastic protein fractions were resolved on a 4-12% gradient SDS/PAGE, blotted to PVDF membrane and the Western blot was developed using a mouse anti-HIS tag primary, goat anti-mouse HRP secondary antibody, an anti-biotin-HRP for the detection of the biotinylated protein ladder, and the Super Signal WestPicowas used for signal detection (Pierce). FIG. 3 indicates a 28 kDa size protein corresponding to the mature Savinase, from both vectors, both in the periplastic and spheroplastic fractions and in both bacterial hosts. It was observed that accumulation of the estimated 28 kDa band in the pro-Savinase expressing E. coli is consistent with pro-Savinase maturation to catalytically active protein.

FIG. 3A shows Savinase enzyme activity. To assess the activity, 50 µL aliquots of the periplasmic and spheroplastic protein fractions were assayed for protease activity using the method described previously. FIG. 3A shows that proSavinase expression resulted in active protease in both E. coli hosts and that expression of the Savinase catalytic domain resulted in inactive protein. Protease activity assays indicated activity from the proSavinase expression cassette both in the spheroplastic and periplasmic fractions in both E. coli hosts. These observations are consistent with proper maturation of the proSavinase to catalytically active Savinase in E. coli. Expression of the catalytic domain alone resulted in inactive protein. This expression-activity profile indicates that the pro-domain plays role in the maturation of active Savinase.

Cytoplasmic Expression of Savinase in E. coli

Figure 4A:
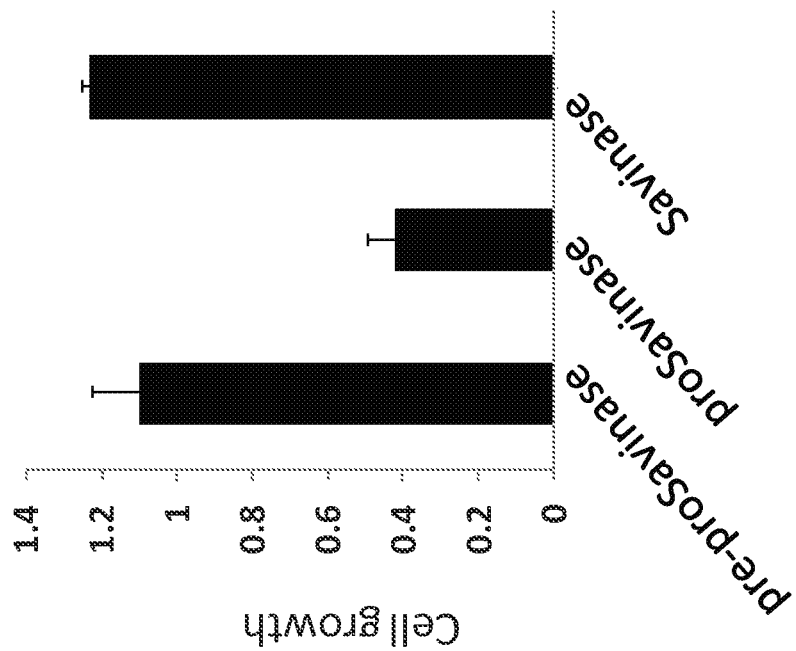
FIG. 4A illustrates protease activity of the Savinase expressed in cytoplasm of *E. coli* SOLR cells.
Figure 4B:
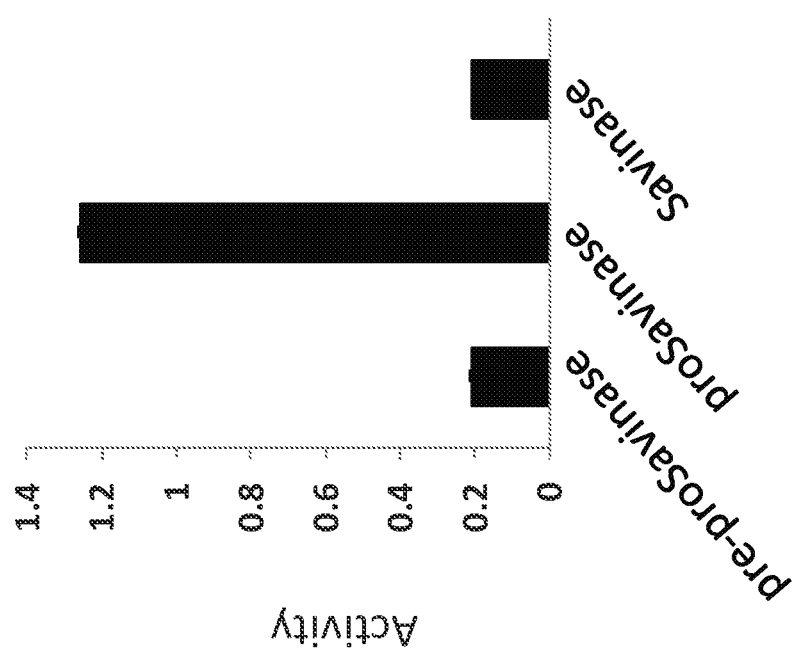
FIG. 4B illustrates the impact of the Savinase cytoplasmic expression on the growth of *E. coli* SOLR cells.

To test cytoplasmic expression of Savinase in E. coli, nucleotide sequences of the full length protein preproSavinase, the proSavinase and the Savinase catalytic domain were cloned into the EcoRI/XhoI sites of pBluescript II XR (Agilent) and expressed in E. coli SOLR cells (Stratagene). Savinase activity was assayed from overnight cultures grown in 5 ml Overnight Express Instant TB Medium (AIM, Novagen) supplemented with carbenicillin 100 mg/L and 0.25 mM IPTG, at 37° C./300 rpm. Cells were harvested at 3000 rpm for 10 min at 4° C. and the pellet was lysed in 100 µL Fast break (1×) in poly-buffer (pH 6.5) for 60 min, then 400 µL poly-buffer was added. To assay enzyme activity 100 µL lysate was added to 100 µL of 1% AZO-casein in 0.1 M Tris.HCl pH 8.0 containing 0.5 mM CaCl2 and samples were incubated at 55° C. for 30 min. Reaction was stopped by adding 200 µL of 5% (w/v) trichloracetic acid, pelleted at 5000 rpm for 5 min, and the absorbance of the supernatant was measured at 340 nm. Protease activity was detectable only from the proSavinase expression cassette. FIGS. 4A-4B illustrate expression of pre-proSavinase, proSavinase and Savinase catalytic domain (Savinase) in the E. coli SOLR cells using pBluescript.

FIG. 4A illustrates enzyme activity assessed in cell lysates of E. coli SOLR cells expressing the full length protein preproSavinase, the proSavinase and the Savinase catalytic domain (Savinase). Average and standard deviation based on three biological replicates. It was observed that activity was detectable only from the proSavinase expression cassette, while expression of the full length protein or the catalytic domain alone gave no activity.

The impact of Savinase activity on the growth of E. coli SOLR cells was assessed (FIG. 4B). E. coli SOLR expressing preproSavinase, the proSavinase and the Savinase catalytic domain were inoculated into 5 mL Overnight Express Instant TB Medium (AIM, Novagen) supplemented with carbenicillin (100 mg/L) and were grown at 37° C. 10 hrs followed by 30° C. 6 hrs. Absorbance of 500 µL culture was measured at 590 nm. E. coli SOLR cells expressing active pro-Savinase grow poorly. Referring to FIG. 4B, it was observed that the cytoplasmic expression of the proSavinas reduced growth, indicating that the protease activity is detrimental to the cells. Similar cytotoxicity effect of pro-Savinase was also found in other E. coli cells (Top10, DH5 alpha and BL21) and in yeast which has being developed as a high throughput screening for cold inducible proSavinase (see Example 23).

The strategy to regulate Savinase described herein is based on the intein technology. It was desirable to develop an intein-modified protease that is inducible to cause splicing by cold and/or dilution of the detergent. For detergent enzyme development both cis- and trans-splicing inteins are equally useful.

Example 10. Strategy for Regulating Protease Activity

Intein technology was used to develop enzymes whose activity can be precisely controlled within specific applications, e.g., to produce an intein-modified protease (iProtease) whose activity was regulated by changes in the concentration of detergent formulations. The goal of regulating protease activity was to improve the protease's stability in liquid detergents used in home care products. Eleven Subtilisin proteases (SEQ ID NOS: 1, 2, 3, 4, 5, 6, 7, 8, 9, 10 and 11) were analyzed and proSavinase (SEQ ID NO: 57) was used for intein modification. Functioning cis- and trans-splicing intein-modified proteases inducible by either decreased temperature in solution, or upon dilution from a concentrated detergent formulation were developed. In addition, it was shown that the intein-modified Savinase could be effective in stain removal following splicing of the intein, as measured by a stain removal assay.

Both cis- and trans-splicing inteins were evaluated at multiple insertion sites within Savinase, and regulated intein-splicing was investigated in response to both cold- and detergent dilution-induction. Analysis of the different molecules and induction stimuli tested showed that detergent dilution-induced trans-splicing was most effective in regulating Savinase activity. The key metrics achieved for the lead trans-splicing molecule (iSavinase-S317:Gp41-1 NI and IC) were a post-splicing activity following a 125-fold dilution of the detergent formulated iSavinase-S317:Gp41-1 trans-splicing protease into water, compared with an activity of nearly 0 (not accurately measurable above baseline) when assayed in detergent following either no dilution or a 125-fold dilution of the detergent formulated iSavinase-S317:Gp41-1 NI and IC into detergent. The activity difference demonstrated by this molecule in our dilution assay was stable for over 17 days, compared to the unmodified Savinase prepared using the same methods which lost all of its activity within five days. In addition, this molecule showed significant stain removal capabilities when 20 µL-100 µL of harvested protein were loaded onto fabric disks stained with either blood, or a blood, milk, and ink mixture.

In addition to the development of dilution-regulated trans-splicing, cis-splicing Savinase molecules were developed that were induced either by dilution of detergent, or by exposure to a lower temperature (20° C.). Expression systems tested were as follows: Bacillus subtilis, Escherichia coli, Saccharomyces cerevisiae, phage, and in vitro transcription and translation (IVTT)). Dilution-induction and cold-induction screening systems, and a novel assaying method for determining enzyme activity in the formulation were developed.

Intein-modified Savinase molecules are referred to herein as "iSavinase", and the intein-modified precursor molecule, which is expressed prior to intein splicing, is referred to herein as a "NIC" (representing the fusion of the amino-extein (N) to the intein (I) to the carboxy-extein (C)). Depending upon the molecule being developed, that is, whether cis- or trans-splicing inteins were being used, and the desired regulatory splicing stimulus, various methods were selected in an effort to minimize the development time, while still optimizing performance of the desired molecule. Regardless of the system used, two types of assays were used universally to develop regulated activity. The first type of assay is called a "Suppression" assay and was used to screen intein-modified molecules for decreased activity under the conditions targeted to suppress intein splicing and therefore enzyme activity (FIG. 5).

Figure 5:
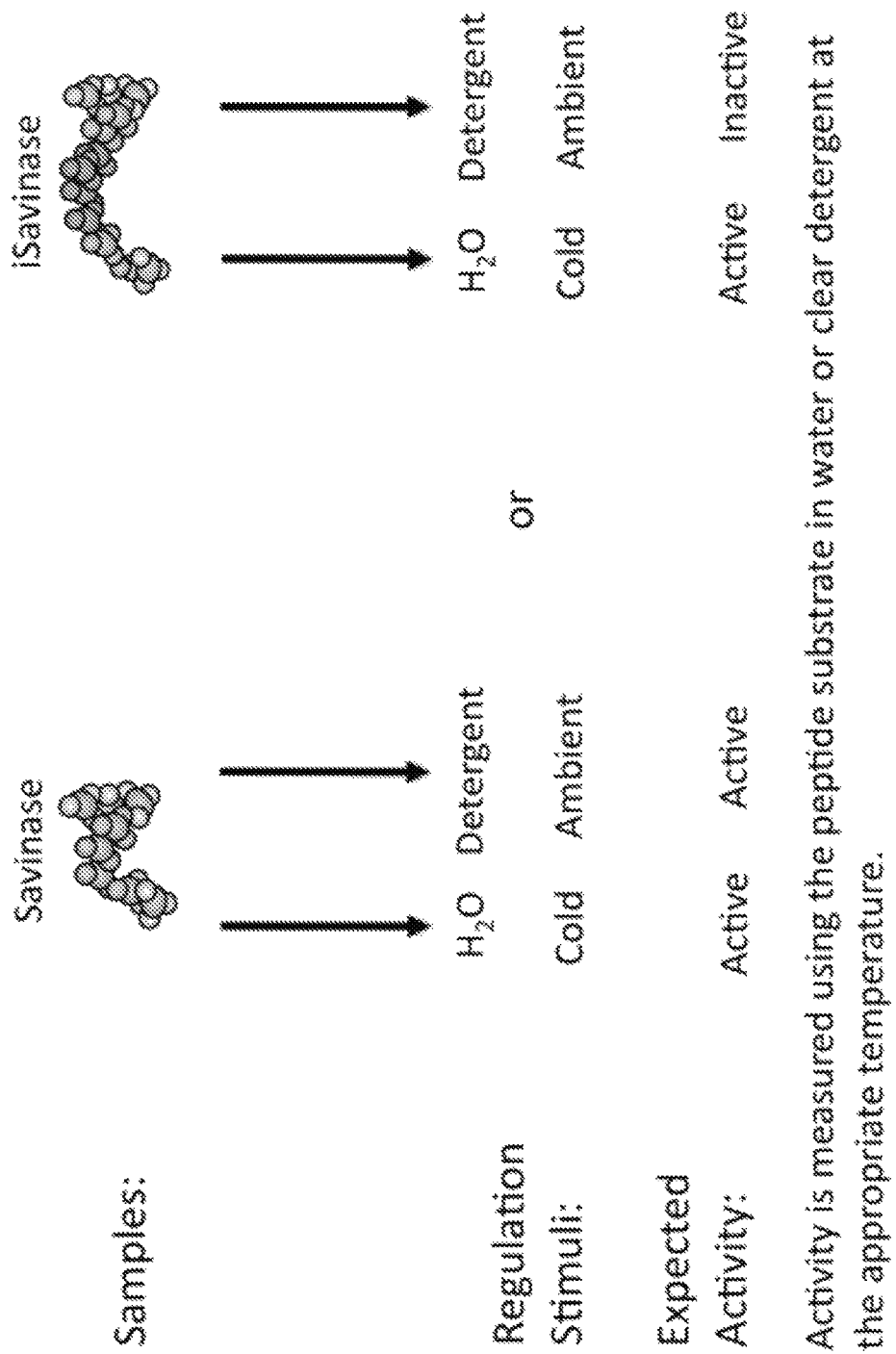
FIG. 5 illustrates a suppression assay.

FIG. 5 illustrates a suppression assay developed for the unmodified (Savinase) and intein-modified Savinase (iSavinase). Referring to this figure, Savinase and iSavinase molecules were assayed under a variety of conditions, regulation stimuli, to determine relative activity differences. The activity of the Savinase and iSavinases were measured across a range of detergent concentrations compared to a water control in order to identify concentrations where the intein-modified Savinase was selectively less active. Likewise, the same molecules were assayed following exposure to different temperatures to determine the relative effect of temperature exposure on intein splicing.

Figure 6:
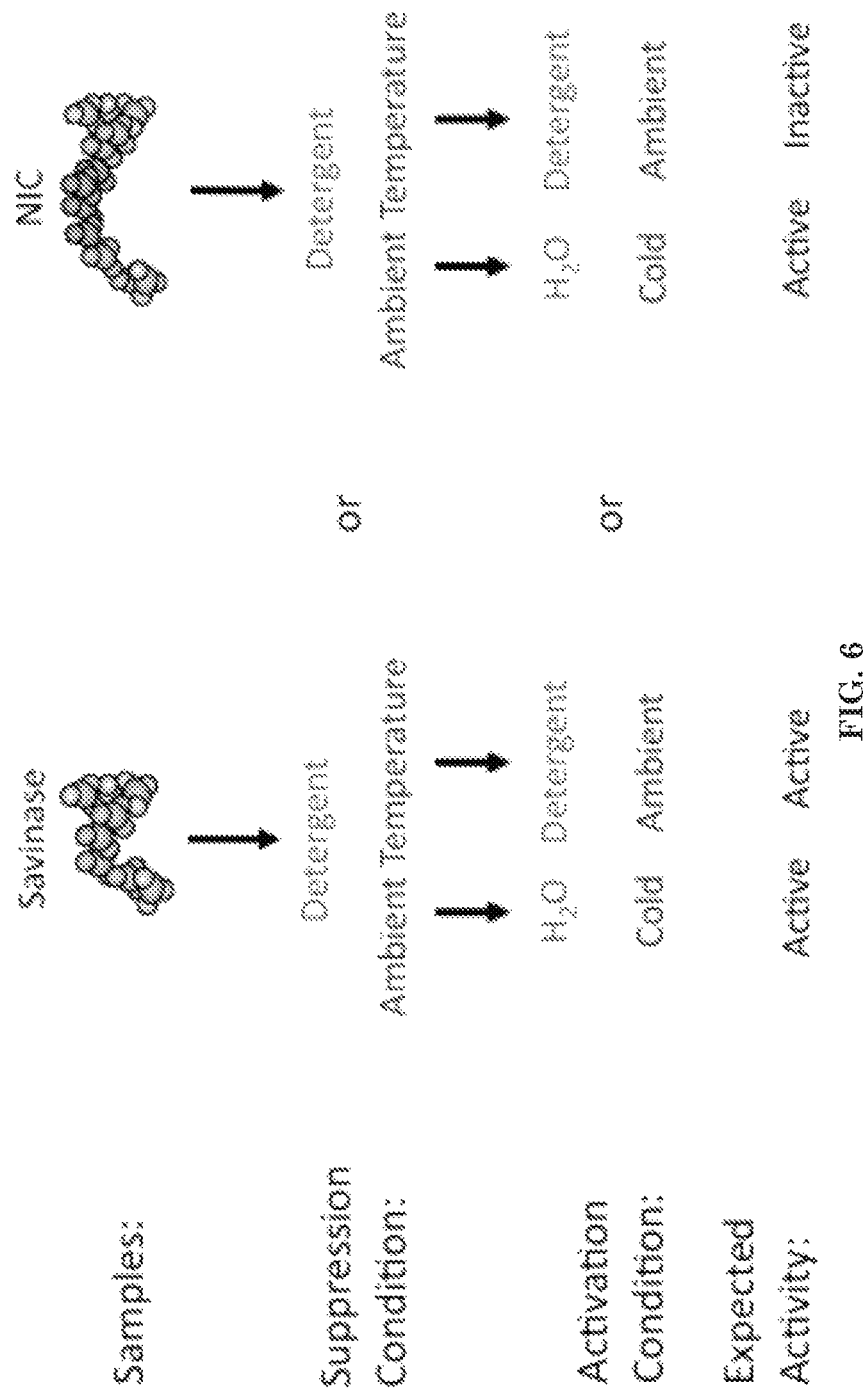
FIG. 6 illustrates an induction assay.

FIG. 6 illustrates the second type of assay called an "Induction" assay that was used to screen intein-modified molecules for the recovery of activity upon exposure to a splicing stimulus, either temperature or detergent dilution. While the suppression assay helped in search for molecules that possess a desirable activity profile, the induction assay addressed the question of whether suppression was reversible and the activity was recoverable from the suppressed state. The induction assay also more closely represented how these molecules would be used in home care products. Both assays were instrumental in the development of regulated, intein-modified proteases that had desirable activity profiles. Referring to FIG. 6, in an induction assay the unmodified (Savinase) and intein-modified Savinase (iSavinase) molecules were initially exposed to the desired suppression condition, where their activity was measured. Afterwards, the molecules were exposed to either the activation condition or left unexposed under the suppression condition, whereupon their activity was again measured and compared to determine quantitatively the amount of recovered activity upon intein-splicing. For example, the activity of the unmodified and intein-modified Savinases was measured following formulation in a high concentration of detergent. The formulated molecules were then diluted into either water or the same concentration of detergent. Intein-modified Savinases that were active upon dilution into water, but inactive upon dilution into detergent, were selected for further development. Likewise, the same molecules were assayed following exposure to different temperatures to determine the relative effect of temperature exposure on intein splicing.

The strategy pursued in developing regulated proteases was designed to address some significant technical challenges. In particular, the challenge of being able to isolate the precursor, intein-modified protease from expression conditions wherein it may be desirable to have the molecule splice was a key consideration. That is, it was desirable to have the intein-modified proteases splice in low detergent (aqueous) environments at moderate temperatures, which are the exact conditions used to express heterologous proteins in most common host organisms, such as *Bacillus, E. coli,* or *Saccharomyces*.

Three design tactics were selected to address this issue. The first strategy was to use trans-splicing inteins, where the protease would be divided into two, inactive fragments, which could be separately expressed and assembled following mixing. While trans-splicing inteins alleviate the challenges associated with producing the precursor molecule, regulated trans-splicing is a less well studied phenomena, which would require additional engineering to develop. The second strategy was to use cold-induced splicing for production and as a proxy for dilution induced splicing from a high concentration of detergent. If low temperatures are required for intein splicing, then the precursor molecule could be produced, isolated, and formulated at elevated temperatures (generally 25° C. to 42° C., depending upon the expressions system). Once formulated, the temperature could be lowered to ambient and the detergent formulation would suppress splicing until dilution occurred. The rationalization for cold-induced splicing as a proxy for detergent dilution splicing was based upon the analysis of cold-induced splicing documented in the literature. In molecules previously shown to splice at lower temperatures, it appeared the lower temperature stabilized the intein such that its confirmation favored intein-splicing. This was in contrast to the intein's confirmation at higher temperature, where it was unstable and largely inactive. Likewise, such inteins may be less stable in high concentrations of detergent, but stabilized when the detergent was diluted and the temperature of the aqueous solution was at or below ambient temperatures (<25° C.). The third strategy was to screen for intein-modified proteases that were relatively insoluble when over-expressed, but could be isolated, solubilized by detergent and refolded, but had low splicing activity until diluted from the detergent. This strategy was one of the most risky, as insoluble proteins are notoriously hard to resolubilize to an active form, let alone one that can be regulated by the presence of a detergent. The following Examples describe the initial testing of Savinase intein-modification and the results obtained using each strategy. Each Example describes the expression system used, the assays employed, and the leading candidates' properties as measured during experiments.

Example 11. Intein Insertion Site Selection in Savinase

Molecular modeling was used to select sites for engineering cis-splicing inteins into the Savinase protease. Sites with a wild-type serine or threonine were analyzed for potential compatibility with intein insertion (no cysteines occur in wild-type Savinase). Three methods were used to select these sites:

[1] Given the inhibitory effect of the protease pro-domain, a serine position (S114) located near the pro-protein cleavage site was selected. An unspliced intein at this position could inhibit pro-domain cleavage and, therefore, protease activation.

[2] The second method was to identify sites near the protein surface that have features similar to previously found successful intein insertion sites. Features include solvent accessibility, secondary structure, local hydrogen bonding environment, residue identity, insertions in homologous proteins, proximity to the active site, and proximity to the protein termini. See James Apgar, Mary Ross, Xiao Zuo, Sarah Dohle, Derek Sturtevant, Binzhang Shen, Humberto dela Vega, Phillip Lessard, Gabor Lazar, R. Michael Raab, "Predictive Model of Intein Insertion Site for Use in the Engineering of Molecular Switches," PLoS ONE, 7(5): e37355, 2012; DOI:10,1371/journal,pone,0037355, which is incorporated by reference herein as if fully set forth. Sites were selected using the crystal structure 1GCI chain A. Selected sites are T148, S166, S253, S269, and S347.

[3] Experimentally testing different intein insertion sites by inserting the intein coding sequence up-stream of each serine or threonine in the Savinase coding sequence.

Because of the importance of the intein splice site, besides using native serines and threonines for intein insertion, the Savinase protein may be mutagenized to incorporate some or all of the wild-type intein splicing cassette amino acids at any desired splice site in the Savinase.

Example 12. Intein Selection

Three inteins were selected for initial testing of intein splicing in Savinase protease. First, given previous success with cold-temperature splicing, the *Saccharomyces cerevisiae* vacuolar ATPase subunit (VMA) intein was selected. Second, the *Thermus thermophilus* HB27 DnaE-1 Tth intein and its engineered miniature mTth intein were selected due to previous successful splicing of this intein in other proteins. Third, the Ssp, DnaE trans-splicing intein was selected for formulating a trans-splicing intein-modified protease. These inteins were be inserted N-terminal to the selected sites. Savinase sequences with the VMA, the Tth or mTth intein inserted into the six or twenty selected sites, respectively, are listed as SEQ ID NOS 25-36, 73-92 and 120-139. Constructs that include proteases with intein sequences are also listed in Table 2.

Example 13. Mutagenesis to Allow any Position to be Used as an Intein Insertion Site A common requirement for intein splicing is to have a serine, threonine, or cysteine amino acid at the C-terminal junction site between the inserted intein and carboxy terminal extein. Given modern molecular biology techniques, any position in a protein can be mutated to contain serine, threonine, or cysteine. Alternately, a serine, threonine, or cysteine could be inserted between any two residues in a protein sequence using modern molecular biology techniques. In either case, an intein can be inserted N-terminal to this modified amino acid and then tested for conditional intein splicing.

Example 14. Expression of Intein-Modified Subtilisin

Both *E. coli* and *Bacillus* species are attractive systems for protease expression and production either as secreted protein or using intracellular expression (Phrommao et al., 2011). One selected method of production is to secrete the recombinant proteins into the culture medium; this method has several advantages including the ability to screen enzyme activity in culture supernatant or on a diagnostic agar plate, which contains a colorimetric substrate that turns color in the presence of active enzyme. Secretion of recombinant *Bacillus* hydrolytic enzymes in *Escherichia coli* expression systems (Yamabhai et al., 2008) demonstrated that various signal peptides of *Bacillus* spp. can be recognized by *E. coli*. Subtilisins have been successfully expressed in several expression systems, including *E. coli* (Phrommao et al., 2011; Fang et al., 2010), *Bacillus subtilis* (Tindbaek et al., 2004; Pierce et al., 1992) and in phage (Legendre et al. (2000). Recent progress in the *B. subtilis* protein expression system, including commercially available *E. coli-B. subtilis* shuttle vectors for intracellular and secreted expression, a *B. subtilis* expression host deficient in eight extracellular proteases and more efficient transformation procedures that can yield up to $4 \times 10^5$ transformants/g DNA (Guoquiang et al., 2011) make *B. subtilis* an attractive host for intein-modified protease development.

Libraries of mutant inteins can be generated by a variety of methods, including random mutagenesis, targeted and saturation mutagenesis, chemical mutagenesis, domain shuffling and overlapping PCR to recombine beneficial mutations. One method to insert an intein library into the target protein Savinase is by overlapping PCR of three DNA fragments encoding the intein and the Savinase N- and C-exteins flanking the insertion site. Another method is to linearize a vector containing the Savinase coding sequence, and co-transform the vector with a library of intein sequences that have overlapping 5'- and 3'-sequences with the restricted vector into yeast; in this method yeast recombination assembles the intein-modified protease directly into the DNA vector. Genes encoding the Savinase with the intein inserted in frame, or subcloned if necessary, into the appropriate expression vector and the library is transformed into the appropriate expression host. The Savinase may be expressed in *E. coli*, using the pET21d vector and the BL21(DE3) host. For *B. subtilis* expression and screening, the mutant library is constructed into shuttle vectors in *E. coli* then transferred into *B. subtilis*. Expressing an intein-modified Savinase in the *E. coli* or phage system offers additional advantages that allow for high-throughput screening of variants from mutagenized library as shown in Example 16.

Example 15. Savinase Enzyme Assay

The substrate for the Savinase enzyme assay is the chromogenic peptide substrate N-Succinyl-Ala-Ala-Pro-Phe p-nitroanilide (Sigma-Aldrich). This substrate is highly specific for subtilisin-like enzymes (Davis et al., 1999) and it can support enzyme assays in bacterium suspensions (Bonifait et al., 2010). In a typical assay, 100 μL of lysate, or bacterium suspension is added to 20 μl of the chromogenic substrate N-succinyl-Ala-Ala-Pro-Phe-pNa (2 mg/mL in 50% dimethyl formamide), the reaction mixture is incubated at 37° C. for variable times and the release of pNA is quantified by measuring the absorbance at 415 nm (Bonifait et al., 2010). This protocol is easily adaptable through automation to support screening by performing high throughput protease activity assays. Proteolytic activity can also be measured by digestion of AZO-casien (Vazquez et al. 2004). Twenty microliters of lysate are incubated in 384-well plate with 20 μL of 1% (w/v) AZO-casein in Tris-HCl buffer (0.1 M, pH8.0) and 0.5 mM CaCl2 at 55° C. for 30 min. After stopping the reaction with 40 μL of 5% (w/v) trichloracetic acid, reaction mixture is centrifuged and absorbance of supernatant was measured at 340 nm.

Example 16. High Throuhput Screening

Screening can be automated to support high-throughput enzyme assays (Bonifait et al., 2010) or diagnostic plates are used where protease activity is detected in a zone of clearance (when using phage) and release of dye from a chromogenic substrate when using phage or a microbial host (Phrommao et al., 2011; You and Arnold, 1994). Screening can be also conducted by exploiting protease cytotoxicity to select for cells that express conditional splicing protease and eliminate those in which intein-modified protease spontaneously splices (see Example 23).

Example 17. Intein Insertions into proSavinase

The mTth:EU59 recombinant intein was inserted into 20 sites before the underlined amino acids: S46, S62, T77, S86, S100, T109, S135, T148, S166, T167, S196, S208, S239, T243, S269, T285, S293, S317, T318, T329 of the proSavinase (SEQ ID NO: 57) after removing the 26 amino acid pre-signal peptide:

MAEEAKEKYLIGFNEQEAV<u>S</u>EFVEQVEANDEVAIL<u>S</u>EEEEVEIELLHEF

E<u>T</u>IPVLSVEL<u>S</u>PEDVDALELDPAI<u>S</u>YIEEDAEV<u>T</u>TMAQSVPWGISRVQA

PAAHNRGLTG<u>S</u>GVKVAVLDTGIS<u>T</u>HPDLNIRGGASFVPGEP<u>S</u><u>T</u>QDGNGH

GTHVAGTIAALNNSIGVLGVAP<u>S</u>AELYAVKVLGA<u>S</u>GSGSVSSIAQGLEW

AGNNGMHVANLSLGSP<u>S</u>PSA<u>T</u>LEQAVNSATSRGVLVVAASGNSGAG<u>S</u>IS

YPARYANAMAVGA<u>T</u>DQNNNRA<u>S</u>FSQYGAGLDIVAPGVNVQSTYPG<u>S</u>TYA

SLNGTSMA<u>T</u>PHVAGAAALVKQKNPSWSNVQIRNHLKNTATSLGSTNLYG

SGLVNAEAATR.

Using overlapping PCR, the constructs were cloned between the EcoRI and XhoI sites of the pBluescript II XR (Agilent) and transformed into E. coli SOLR cells (Stratagene). The nucleotide sequence mTth:EU59 recombinant intein of SEQ ID NO: 72 encoding mTth:EU59 recombinant intein (SEQ ID NO: 119) were inserted into proSavinase that resulted in intein-modified proSavinase constructs: proSavinase S46-mTth:EU59 (SEQ ID NO: 73), proSavinase S62-mTth:EU59 (SEQ ID NO: 74), proSavinase T77-mTth:EU59 (SEQ ID NO: 7), proSavinase S86-mTth:EU59 (SEQ ID NO: 76), proSavinase S100-mTth:EU59 (SEQ ID NO: 77), proSavinase T109-mTth:EU59 (SEQ ID NO: 78), proSavinase S135-mTth:EU59 (SEQ ID NO: 79), proSavinase T148 mTth:EU59 (SEQ ID NO: 80), proSavinase S166-mTth:EU59 (SEQ ID NO:81), proSavinase T167-mTth:EU59 (SEQ ID NO: 82), proSavinase S196-mTth:EU59 (SEQ ID NO: 83), proSavinase S208-mTth:EU59 (SEQ ID NO: 84), proSavinase S239-mTth:EU59 (SEQ ID NO: 85), proSavinase T243-mTth:EU59 (SEQ ID NO: 86), proSavinase S269-mTth:EU59 (SEQ ID NO:87), proSavinase T285 mTth:EU59 (SEQ ID NO: 88), proSavinase S293 mTth:EU59 (SEQ ID NO:89), proSavinase S317-mTth:EU59 (SEQ ID NO: 90), proSavinase T318-mTth:EU59 (SEQ ID NO: 91), and proSavinase T329-mTth:EU59 (SEQ ID NO:92) encoding the following intein-modified proSavinases: proSavinase S46-mTth:EU59 (SEQ ID NO: 120), proSavinase S62-mTh:EU59 (SEQ ID NO: 121), proSavinase T77-mTth:EU59 (SEQ ID NO: 75 122), proSavinase S86-mTth:EU59 (SEQ ID NO: 123), proSavinase S100-mTth:EU59 (SEQ ID NO: 124), proSavinase T109-mTth:EU59 (SEQ ID NO: 125), proSavinase S135-mTth:EU59 (SEQ ID NO: 126), proSavinase T148 mTth:EU59 (SEQ ID NO: 127), proSavinase S166-mTth:EU59 (SEQ ID NO: 128), proSavinase T167-mTth:EU59 (SEQ ID NO: 129), proSavinase S196-mTth:EU59 (SEQ ID NO: 130), proSavinase S208-mTth:EU59 (SEQ ID NO: 131), proSavinase S239-mTth:EU59 (SEQ ID NO: 132), proSavinase T243-mTth:EU59 (SEQ ID NO: 133), proSavinase S269-mTth:EU59 (SEQ ID NO: 134), proSavinase T285 mTth:EU59 (SEQ ID NO: 135), proSavinase S293 mTth:EU59 (SEQ ID NO: 136), proSavinase S317-mTth:EU59 (SEQ ID NO: 137), proSavinase T318-mTth:EU59 (SEQ ID NO: 138), and proSavinase T329-mTth:EU59 (SEQ ID NO: 139. Inteins were also inserted into proSavinase by using yeast homologous recombination (see Example 23. Cold regulated cis-splicing iSavinase).

Example 18. Intein Insertion into proSavinase can Suppress and Splicing can Restore Savinase Activity

*E. coli* SOLR cells expressing the iproSavinases were grown in overnight cultures and cell lysates were prepared as in the method described for FIG. 5A. To test for temperature shift inducible splicing, aliquots of cell lysate were incubated separately at 4, 37 or 55° C. for 2 hrs, then proteins were resolved on SDS/PAGE and Western blotted using the intein specific antibody against EU59. FIG. 7B shows Western blot of intein splicing. Positions of the iproSavinase (NIC) and the free intein (mTth:EU59) released after splicing are marked at the left. Intein insertion sites are indicated below. The three lanes above each insertion site are aliquots pretreated at 4, 37 and 55° C. for 2 hrs, respectively. In the lines below, (+) or (−) for each insertion site indicates presence or absence of the spliced free intein from which xylanase activity was derived. Intein splicing, scored by release of the intein from the precursor, was detectable at five out of the 20 insertion sites tested including the S135, S269, S293, S317, and T318.

Intein splicing restored Savinase activity as was demonstrated by the enzyme activity assay. *E. coli* SOLR cells expressing the intein-modified proSavinase were grown and enzyme activity was assayed from bacterial lysates as described for FIG. 5A.

FIGS. 7A-7B illustrate correlation of target enzyme activity with intein splicing. Xylanase EU59-modified mTth intein was inserted into proSavinase at various Serine (S) and Theorine (T) sites to generate multiprotein cassettes that express both xylanase and protease. For each construct, 16 biological replicates were tested: eight were pre-incubated at 37° C. (filled rectangle) and eight at 55° C. (open rectangle) for 2 hrs, respectively, to facilitate splicing and recovery of enzyme activity before the enzyme activity was assayed. Cell lysate from representative cassettes was assayed for enzyme activation and intein splicing. It was observed that intein-modified proSavinases that showed splicing also showed enzyme activity (S135, S269, S293 and S317).

FIG. 7A shows that protease assay demonstrated Savinase activity in four (S135, S269, S293 and S317) of the seven cassettes. A preheating treatment at 37° C. and 55° C. for 2 hrs yielded Savinase activity from these cassettes. FIG. 7B illustrates Western blotting using EU59 antiserum. Referring to this figure, a band matching the size of the EU59-modified mTth intein was detected for all four cassettes shown in FIG. 7A. The mTth:EU59 intein splicing was observed in the S135 and S317 cassettes at all three temperatures tested (dash 4° C., thin line 37° C. and bold line 55° C., for 2 hrs). However, in the S269 and S293 cassettes intein splicing was observed only after the lysate was preheated at 55° C. These results suggest that intein modification could be a useful tool to control protease activity.

Example 19. mVMA:P77Cd and mTth:P77Cd Modified Savinase

Like EU591743 (EU59), XynB (Accession number P77853) is also a GH11 family xylanase. Its catalytic domain P77853Cd (P77Cd) (SEQ ID NO: 714) has sequence homology to EU59 xylanase (SEQ ID NO: 715]. Compared to the full length XynB, P77Cd expressed well in E. coli, was highly soluble in solutions and showed increased thermo-tolerance and specific activity. SceVMA is an intein that has been extensively studied and successfully used in developing cold inducible protein switch. A homing endonuclease domain was predicted in its sequence.

P77Cd was fused internally into SceVMA in place of the HEN domain. Four constructs were generated, either without a link or with the eight amino acid link at the N-terminal, or the C-terminal or both N- and C-termini of P77Cd. When expressed in E. coli, the constructs with none or one link between P77Cd and SceVMA gave better xylanase activity on AZCL-xylan substrate, demonstrating xylanase activity in the modified intein (mVMA:P77Cd; SEQ ID NO: 684). The nucleic acid sequence of SEQ ID NO: 699 encoded the modified mVMA:P77Cd. The modified mVMA:P77Cd intein was then inserted into Savinase before S135, S265, S269, S293, S312, S317 and S326 to generate constructs iproSavS135:mVMA:P77Cd (SEQ ID NO: 701), iproSavS265:mVMA:P77Cd (SEQ ID NO: 702), iproSavS269:mVMA:P77Cd (SEQ ID NO: 703), iproSavS293:mVMA:P77Cd (SEQ ID NO: 704), iproSavS312:mVMA:P77Cd (SEQ ID NO: 705) iproSavS317:mVMA:P77Cd (SEQ ID NO: 706), iproSavS326:mVMA:P77Cd (SEQ ID NO: 707). For iproSavS312:mVMA:P77Cd and iproSavS326:mVMA:P77Cd, alanine mutation was also introduced in the intein termini, creating a crippled intein of SEQ ID NO: 712 (iproSavS312:mVMA-c:P77Cd), and SEQ ID NO:713 (iproSavS326:mVMA-c:P77Cd). The constructs encoded the following proteins with amino acid sequences of iproSavS135:mVMA:P77Cd (SEQ ID NO: 686), iproSavS265:mVMA:P77Cd (SEQ ID NO: 687), iproSavS269:mVMA:P77Cd (SEQ ID NO: 688), iproSavS293:mVMA:P77Cd (SEQ ID NO: 689), iproSavS312:mVMA:P77Cd (SEQ ID NO: 690), iproSavS317:mVMA:P77Cd (SEQ ID NO: 691), iproSavS326:mVMA:P77Cd (SEQ ID NO: 692), iproSavS312:mVMA-c:P77Cd (SEQ ID NO: 697), and iproSavS326:mVMA-c:P77Cd (SEQ ID NO: 698). Xylanase assay showed that mVMA:P77Cd intein was able to splice because high level of xylanase activity was observed in iproSavS312:mVMA:P77Cd and iproSavS326:mVMA:P77Cd but not in their crippled counterpart (FIG. 8).

Similarly, mTth:P77Cd intein was constructed by inserting P77Cd into mTth intein. Depending on whether or not a linker was present and where it was present between P77Cd and the amino terminal of the mTth or between P77Cd and the carboxy terminal of the mTth, four mTth:P77Cd constructs were generated by PCR, expressed in E. coli SOLR cells as described above. Xylanase activity assay showed that three (with an eight amino acid linker at 3' or 5' or both ends of P77Cd) of the four constructs yielded more than 50% xylanase activity of P77Cd. The construct that has a 3' linker was inserted in proSavinase at S135, S269, S293 and S317 sites to generate the following new constructs iproSavS135:mTth:P77Cd (SEQ ID NO: 708), iproSavS269:mTth:P77Cd (SEQ ID NO: 709), iproSavS293:mTth:P77Cd (SEQ ID NO: 710), and iproSavS317:mTth:P77Cd (SEQ ID NO: 711).

To assay xylanase activity in a xylanase modified intein, such as mTth:P77Cd, E. coli SOLR cells expressing a modified intein were inoculated from individual colonies and grown in 96-well plates containing 1 mL of AIM (Novagen) supplemented with carbenicillin (100 mg/L) at 37° C. for 10 hrs and then at 30° C. for 6 hrs in a shaking incubator (New Brunswick), at 900 rpm. Cells were harvested at 4000 rcf for 10 min, pellets were resuspended in 100 μL lysis buffer containing 200 mM sodium phosphate (pH 6.5), 1× FastBreak Lysis Buffer™ (Promega), and 0.2 μL DNase/mL Benzonase nuclease (Novagen). Additional 400 μL 200 mM sodium phosphate buffer (pH6.5) was added to each lysate. Seventy microliters lysate was transferred to 384-well plates, heat treated at 25° C.-65° C. for up to 4 hrs and cooled to 25° C. All samples were mixed with 0.2% (w/v) fine ground solid substrate of AZCL-xylan oat (Megazyme) and incubated at 37° C. for approximately 1 hrs. Reaction samples were vortexed, centrifuged at 4,000 rcf for 7 min, and 50 μL aliquots of the supernatant were measured for absorbance at 590 nm on a Paradigm microplate reader. Average activity and standard deviations were calculated from assays of extracts from 8-12 independently inoculated replicate cultures.

Figure 8:
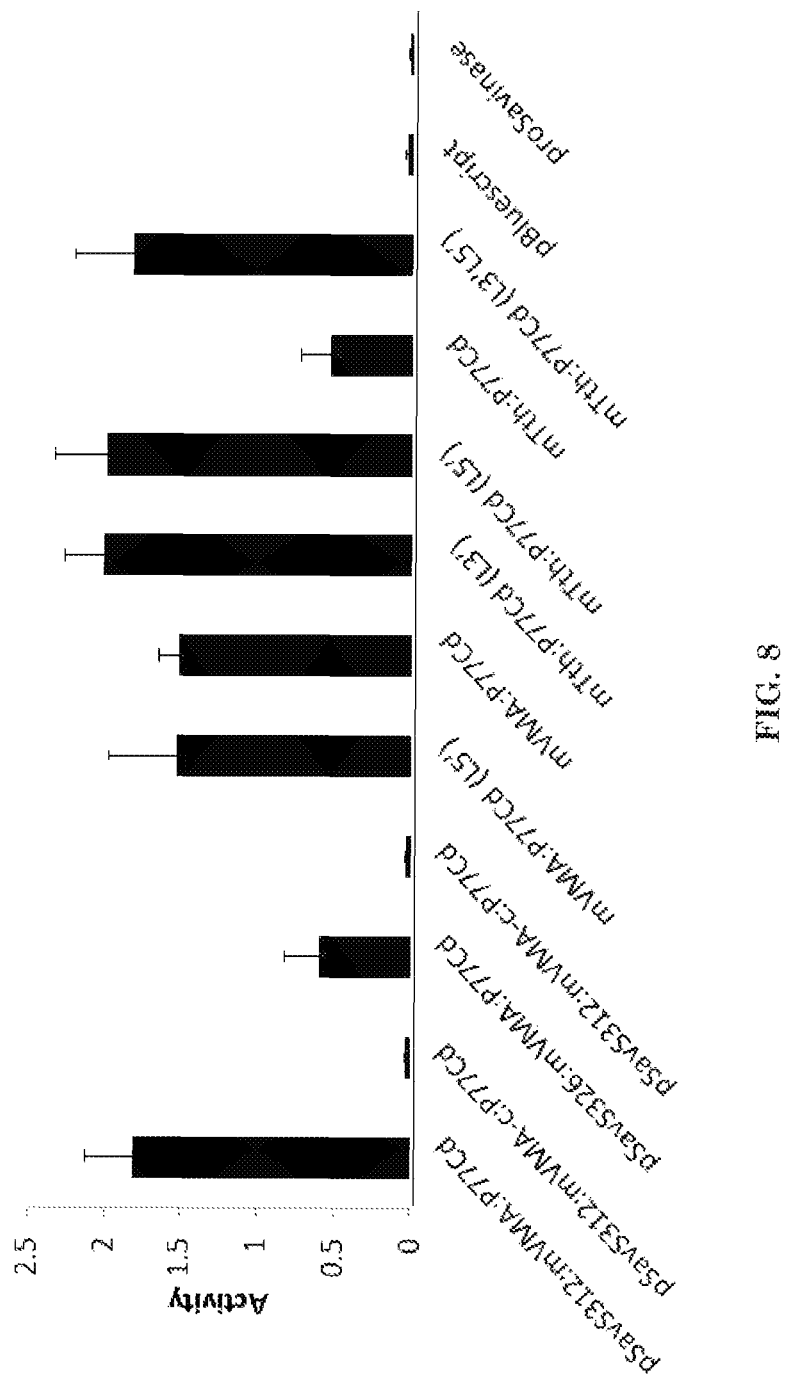
FIG. 8 illustrates application of modified mVMA:P77Cd and mTth:P77Cd inteins for splicing proSavinase.

FIG. 8 shows that xylanase assay demonstrated usefulness of mVMA:P77Cd and mTth:P77Cd inteins. Referring to this figure, it was observed that mVMA:P77Cd and mTth:P77Cd with or without an eight amino acid peptide linker inserted before P77Cd (L5') or after P77Cd (L3') showed xylanase activity. This xylanase activity could be recovered when mVMA:P77Cd was inserted in proSavinase at S312 and S326 sites (pSavS312:mVMA:P77Cd and pSavS326:mVMA:P77Cd, respectively). However, disabling intein splicing also eliminated xylanase activity, suggesting that the modified mVMA:P77Cd and mTth:P77Cd inteins could splice.

Example 20. Detergent Dilution Inducible Protease

Screening for intein-modified protease that are inducible upon dilution poses unique problems in that the expressed intein-modified protease must enable formulation of the protein into a detergent prior to splicing, but still allow for splicing upon dilution from the detergent, which may result under conditions that are similar to the expression conditions. Thus one challenge is in expressing a stable intein-modified protease in a low concentration or absence of detergent, formulating the intein-modified protease in a detergent wherein it cannot splice, and then activating splicing upon dilution of the detergent. Several strategies may be used to address this challenge. One strategy would be to identify expression conditions that are different from the splicing conditions, which occur upon dilution of the detergent. For example, the intein-modified protease can be expressed at a higher temperature where splicing is inhibited, the detergent can be formulated at the inhibitory temperature, and then diluted at a lower temperature (<20° C.) which may trigger intein splicing and protease activation. Although detergent does not necessarily play a role in intein splicing in the previous case, its effect on intein splicing could be exploited. For example, intein-modified protease could be identified that only splices upon exposure to certain diluted detergent, wherein concentrated detergent inhibits splicing.

Another strategy would be to express the intein-modified protease into a form where splicing was inhibited, such as at a high concentration where aggregation or inclusion body formation may occur, solubilize the intein-modified protease in the detergent where it could re-fold but splicing was still inhibited, and then dilute the re-folded intein-modified protein from the detergent where it could splice. A similar strategy would be to express the intein-modified protease so that the enzyme was secreted into a medium that contained a splicing inhibitor (such as zinc), formulate the intein-modified protein in the presence of the inhibitor and detergent, and then dilute both the inhibitor and detergent, enabling the intein-modified protease to splice and become active. Yet another strategy would be to use a trans-splicing intein-modified protease wherein both intein-modified exteins were expressed separately and formulated in a detergent that prevented splicing, but allowed trans-splicing of the intein upon dilution of the detergent, activating the protease.

Example 21. Dilution Regulated Trans-Splicing iSavinase

Figure 9:
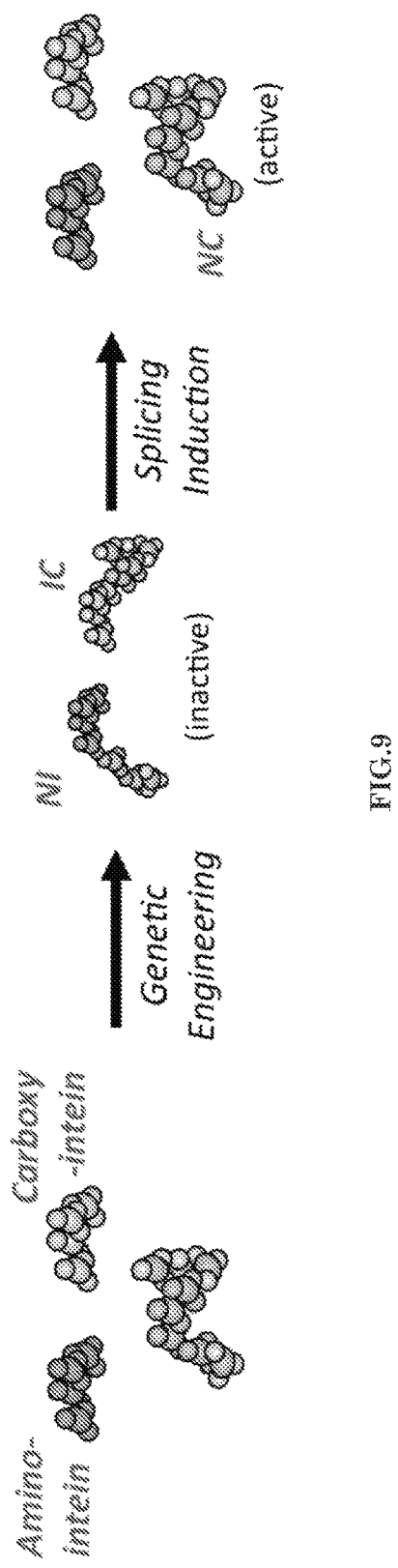
FIG. 9 illustrates an overview of trans-splicing protein assembly.

Trans-splicing inteins support a binary approach to controlling Savinase activity. FIG. 9 illustrates trans-splicing protein assembly. Referring to this figure, Savinase was split into two inactive peptide fragments, which were individually expressed as fusions to trans-splicing inteins, an amino intein (NI) and a carboxy-intein (IC). Mixing the two intein-modified Savinase peptide fragments triggered intein mediated association of the inactive fragments, splicing and seamless joining of the inactive parts into a fully functional enzyme. The first step in developing an intein-modified Savinase was to analyze potential intein insertion sites in the Savinase protein sequence. Inteins require either a serine (S), threonine (T) or cysteine (C) residue at the C-terminal side of the intein insertion site in order for the splicing reaction to occur. There are no cysteine residues in Savinase, leaving only native serine and threonine sites to choose from, without having to mutate the native enzyme sequence. All native intein insertion sites were analyzed computationally and over 20 sites were experimentally tested using either a model intein, or a cis-splicing version of a trans-splicing intein (essentially linking the two pieces of a trans-splicing intein with a small peptide bridge). Based on this analysis and the experimental data, four initial sites were selected for intein insertion: serine 135 (S135), serine 293 (S293), serine 317 (S317) and threonine 318 (T318).

Figure 10:
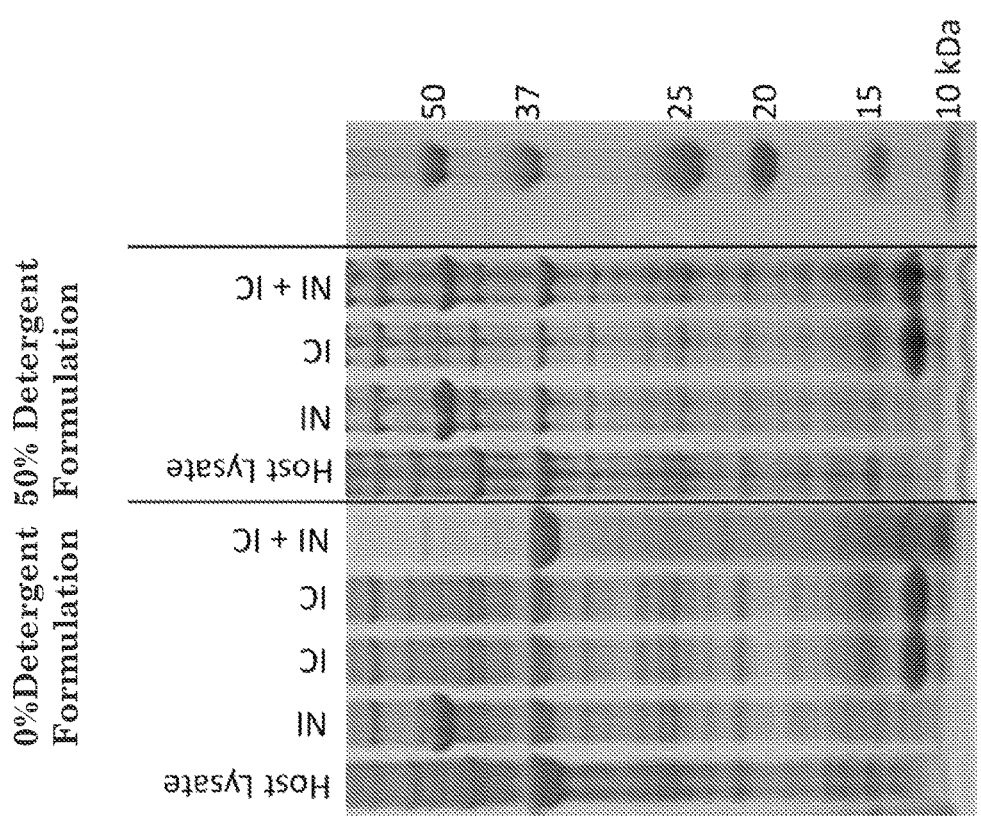
FIG. 10 illustrates visualization of trans-splicing iSavinase detergent suppression.

After assessing the intein insertion sites, five trans-splicing (or "split") inteins were selected to evaluate for development of regulated trans-splicing. The selected trans-splicing inteins were: NrdJ-1, Gp41-1, IMPDH-1, Gp41-8 and the Ssp DnaE. Trans-splicing iSavinase molecules were constructed using these inteins and expressed in *E. coli*. Of these inteins, Gp41-1 in insertion site 317 provided significant maturation and activation of the trans-splicing iSavinase in a detergent suppression assay as shown in FIG. 10. Referring to this figure, pProtein samples were run on SDS-PAGE and stained with Coomassie blue dye to visualize the protein bands. In this figure, NI represents the amino-terminal intein-modified peptide of iSavinase (appearing at approximately 48 kDa on the gel), IC represents the carboxy-terminal intein-modified peptide of iSavinase (appearing at approximately 12 kDa on the gel), NI+IC represents a mixture of the NI and IC peptides, and Host Lysate shows the background protein bands from the untransformed *E. coli* host. The NI and IC fragments are clearly visible in these lysates and in the NI+IC mixture when formulated at a concentration of 50% (vol/vol) detergent. In contrast, formulating the NI+IC in water shows little or no remaining bands of the NI and IC individually, and shows significant degradation of the other protein bands in the lysate, indicative of fully active Savinase.

Figure 11:
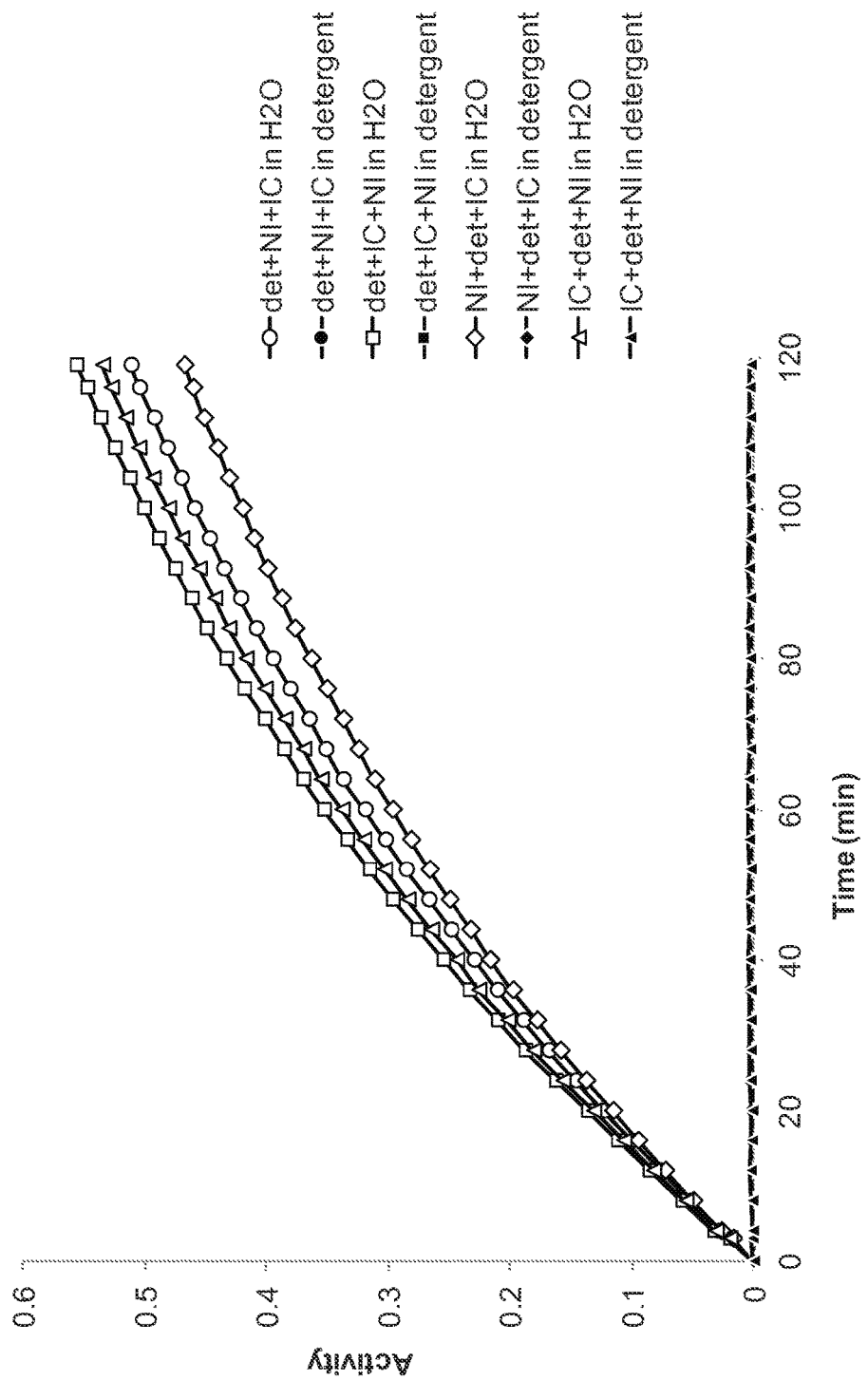
FIG. 11 illustrates a dilution assay using detergent regulated trans-splicing iSavinase: S317-Gp41-1 NI and IC.

These constructs were further tested in a dilution assay to determine the activity of the NI, IC, and mixture (NI+IC) relative to unmodified Savinase in ~100% detergent and when diluted from 100% detergent to <1% detergent as would be observed in washing applications. In order to ensure enough enzyme would be present to obtain a measurable signal in the assay following dilution, the proteins were concentrated prior to formulation in the detergent, using either acetone precipitation or MW cutoff filters. The concentrated proteins were then formulated and tested in the dilution assay. FIG. 11 illustrates dilution assay using detergent regulated, trans-splicing iSavinase: S317-Gp41-1 NI and IC. Referring to this figure, equal volumes of iSavinase-NI, iSavinase-IC in mTSB-Ca supplemented with 10 mM DTT were mixed with 50% detergent in water, at four different orders of assembly. Detergent final concentration in the mix was 25%. After overnight incubation at ambient temperature, aliquots from each sample were diluted to water and detergent and iSavinase activity was assayed over 120 minutes using the succinyl FAAF-pNA substrate. Aliquots diluted to water all showed protease activity, aliquots diluted to detergent showed no activity. As seen in the figure, the NI+IC formulation remained inactive when diluted into detergent, but regained significant amounts of activity when diluted into water. NI and IC individually were inactive whether diluted into water or detergent. In these experiments, a colorless detergent formulation was used so that the activity could be measured directly in the detergent using the standard peptide substrate.

Because these constructs demonstrated significant detergent-dilution regulation, more protein was produced and used in stain removal assays using experimental fabric disks. The fabric disks were stained either with blood, or with a combination of blood, milk, and ink. While initial attempts at stain removal using NI and IC lysates were not successful in demonstrating significant levels of stain removal, it was suggested that the NI and IC formulation, which contained elevated concentrations of salt (components of a commonly used trans-splicing buffer), may inhibit stain removal due to the higher salt concentrations. Indeed, when the NI and IC mixture was used in the stain removal assay with low concentrations of salt, significant stain removal was observed as shown in FIGS. 13 and 14.

Figure 12:
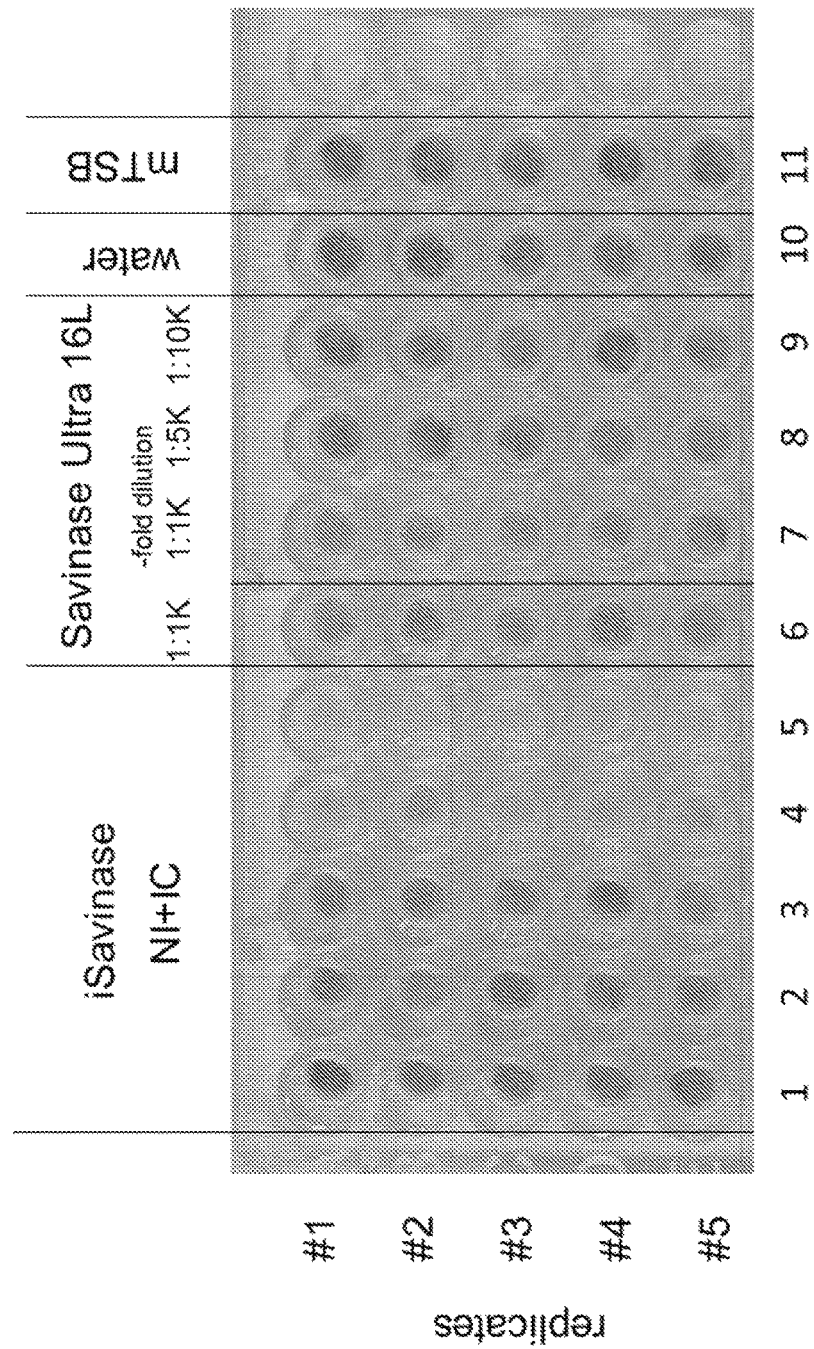
FIG. 12 illustrates blood stain removal using trans-splicing iSavinase.

FIG. 12 illustrates blood stain removal using trans-splicing iSavinase. Different volumes of NI+IC lysates were formulated and loaded onto the stained fabric disks to examine the effects of concentration on stain removal. Similarly, different concentrations of Savinase Ultra 16L were also loaded onto the stained fabric disks. Water and the trans-splicing buffer, mTSB, were used as negative controls. Referring to this figure, iSavinase was made in a trans splicing reaction of purified iSav-NI and iSav-IC in mTSB-Ca supplemented with 1 mM DTT at 37° C. for 80 min, desalted on a Zeba Spin Desalting column 7 K Mwco (Thermo Fisher) and put on ice. iSavinase concentration was ~0.94 µg/µL. Control Savinase Ultra 16L (approximately 103 g/L) was freshly diluted into deionized water 1:1000, 1:5000 and 1:10000 (v/v) and stored on ice. Each treatment was made in five replicates. To each well containing dried blood stained fabric disk the following reagents were added: 20 µL 10× detergent (2.5% v/v in deionized water), 20 µL 10× boric acid 200 mM (pH 9.0) and 6 µL of 120 FH (8 mM CaCl2 and 4 mM MgCl$_2$ in deionized H$_2$O). H$_2$O was added to wells 1, 2, 3, 4, 5, 6, 7, 8, 9, 10, and 11 in volumes of 149, 144, 134, 104, 54, 129, 134, 134, 134, 154, and 149 µL, respectively. mTSB-Ca supplemented with 1 mM DTT was added to wells 6 and 11, each 5 µL. Enzyme was added last to a final sample volume of 200 μL: iSavinase was added to wells 1, 2, 3, 4, and 5 in increasing volumes of 5, 10, 20, 50 and 100 μL, respectively. Savinase Ultra 16L indicated dilutions were added to wells 6, 7, 8, and 9 at 20 μL volume each. Samples were mixed by pipeting and plates were incubated at 37° C. for 1 hr. Supernatant was removed and after adding 200 μL deionized water to each well, the plate was put on a shaker for approximately 45 sec. Supernatant was removed, the wash step was repeated two more times and the disks were dried in the wells overnight at ambient temperature. It was observed that, the trans-splicing iSavinase provided significant stain removal performance beginning at a 50 μL lysate loading.

Figure 13:
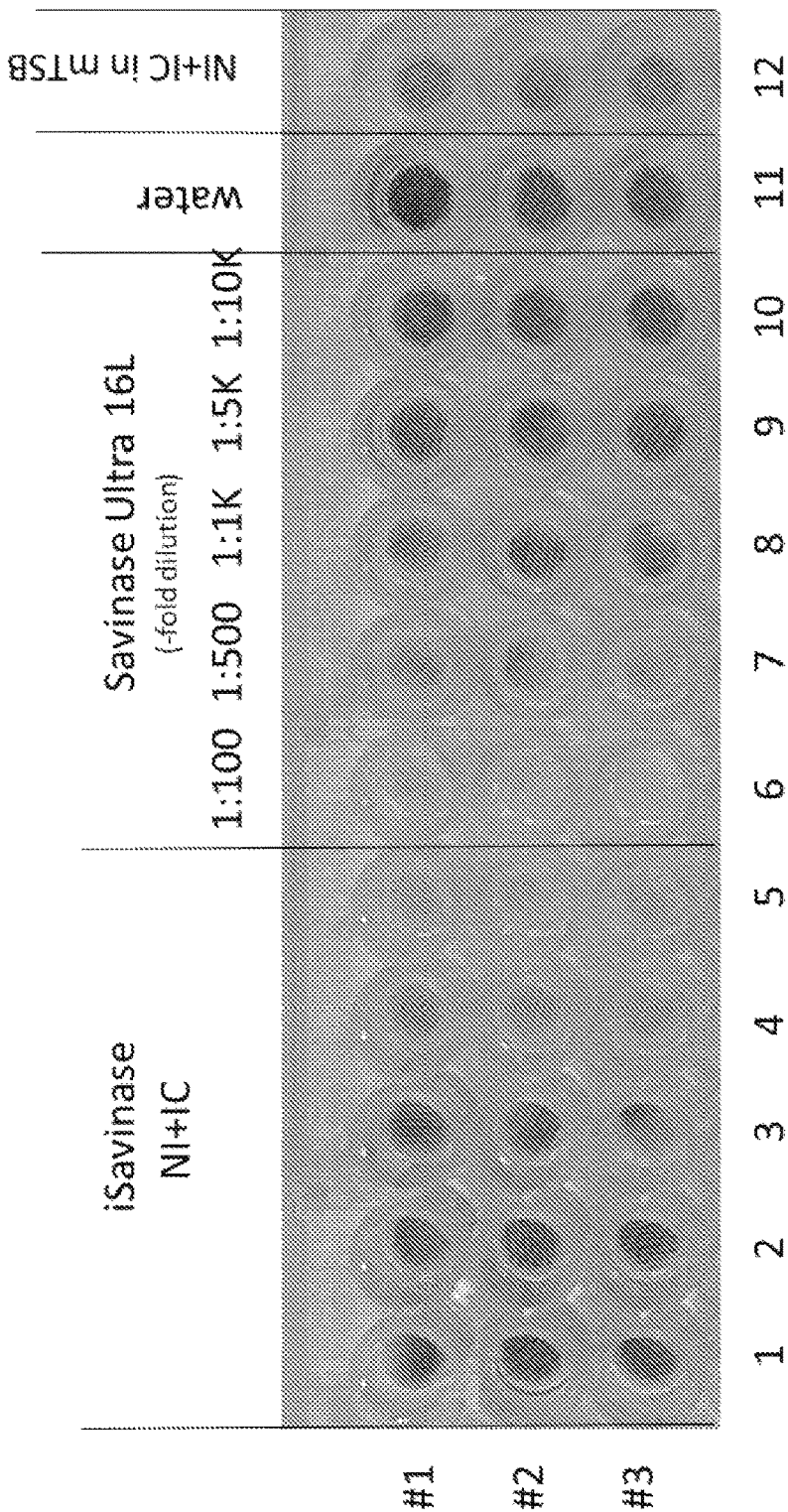
FIG. 13 illustrates blood, milk, and ink stain removal using trans-splicing iSavinase.
Figure 14:
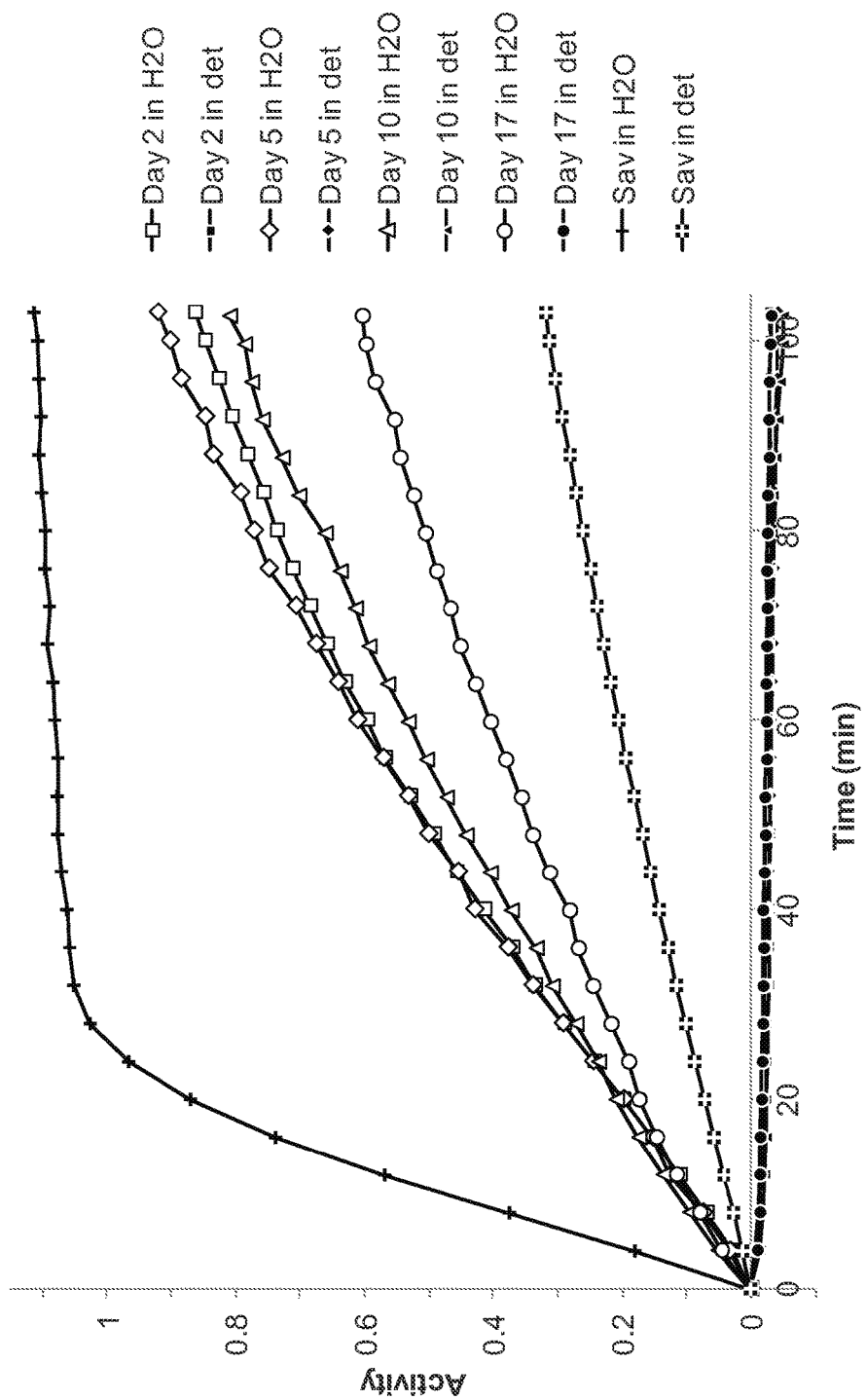
FIG. 14 illustrates detergent stability testing of trans-splicing iSavinase: S317-Gp41-1 NI and IC.

FIG. 13 illustrates blood, milk, and ink stain removal using trans-splicing iSavinase. iSavinase was made in a trans splicing reaction of purified iSav-NI and iSav-IC in mTSB-Ca supplemented with 1 mM DTT at 37° C. for 80 min, desalted on a Zeba Spin Desalting column 7 K Mwco (Thermo Fisher) and put on ice. iSavinase concentration was approximately 0.94 g/L. Control Savinase Ultra 16L (approximately 103 g/L) was freshly diluted into deionized water 1:100, 1:500 and 1:1000, 1:5000 and 1:10000 (v/v) and stored on ice. Each treatment was made in three replicates. To each well containing dried blood, milk and ink stained fabric disk the following reagents were added: 20 μL 10× detergent (2.5% v/v in deionized water), 20 μL 10× boric acid 200 mM (pH 9.0) and 6 μL of 120 FH (8 mM CaCl2 and 4 mM $MgCl_2$ in deionized H2O). $H_2O$ was added to wells 1, 2, 3, 4, 5, 6, 7, 8, 9, 10, 11, and 12 in volumes of 149, 144, 134, 104, 54, 134, 134, 134, 134, 134, 154, and 54 μL, respectively. Enzyme was added last to a final sample volume of 200 μL: desalted iSavinase was added to wells 1, 2, 3, 4 and 5 in increasing volumes of 5, 10, 20, 50, and 100 μL, respectively. To well 12, 100 μL iSavinase was added in mTSB-Ca supplemented with 1 mM DTT. Savinase Ultra 16L dilutions were added to wells 6, 7, 8, 9 and 10, each 20 μL. Samples were mixed by pipeting and plates were incubated at 37° C. for 1 hr. Supernatant was removed and after adding 200 uL deionized water to each well, the plate was put on a shaker for approximately 45 sec. Supernatant was removed, the wash step repeated two more times and the disks were dried in the wells overnight at ambient temperature.

Different volumes of NI+IC lysates were formulated and loaded onto the stained fabric disks to examine the effects of concentration on stain removal. Similarly, different concentrations of Savinase Ultra 16L were also loaded onto the stained fabric disks. Water was used as a negative control. To show the effects of TSB on stain removal, 100 μL of NI+IC was also formulated with 100 μL of TSB, and showed a measured suppression of stain removal (comparing lanes 5 and 12), despite full activation of the iSavinase under both sets of conditions as determined by activity assay. Based on these results, the trans-splicing iSavinase provides significant stain removal performance beginning at a 50 μL lysate loading. Preparations of the NI and IC in >90% detergent formulation were tested over time. These preparations showed very significant maintenance of detergent-dilution regulated activity over the time periods tested (up to 17 days). In contrast, unmodified Savinase identically prepared and formulated lost the majority of its activity within five days. These results suggest a significant and unpredictable benefit to formulating NI and IC in detergents as opposed to unmodified Savinase, which rapidly loses its activity, and therefore will require significantly higher enzyme concentrations to ensure activity throughout the detergent's useful life.

FIG. 14 illustrates detergent stability testing of trans-splicing iSavinase:S317-Gp41-1 NI and IC. Samples of formulated NI+IC were tested over a 17-day period and showed continued maintenance of activity in the detergent-dilution assay. Referring to this figure, iSavinase-NI and iSavinase-IC lysates were acetone precipitated and formulated into detergent as described in Materials and Methods. Formulated sample was stored at ambient temperature and the stability of formulated iSavinase-NI and -IC was tested in detergent dilution assay over 17 days. Aliquots diluted to water showed activity at each time point, aliquots diluted to detergent showed no activity at all time points. In contrast, unmodified Savinase lost significantly greater amounts of activity when formulated and assayed over the same time period.

Example 22. Dilution Regulated Cis-Splicing iSavinase

Figure 15:
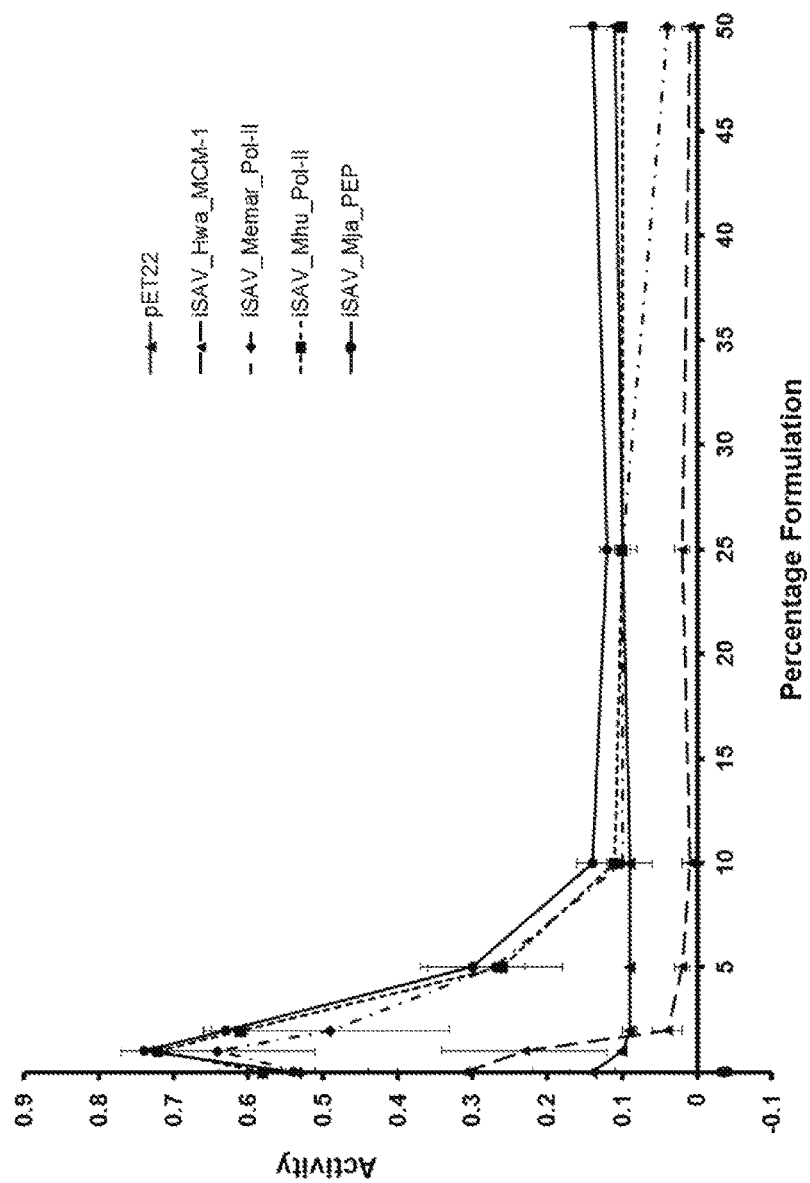
FIG. 15 illustrates a detergent suppression assay for cis-splicing iSavinase constructs.

Based on analysis of the unmodified Savinase enzyme, 20 different potential intein insertion sites were evaluated experimentally by activity assay and Western blot using a model intein. This evaluation focused the efforts on the putative intein insertion sites in Savinase, serine 135 (S135) and serine 317 (S317), for continued development. Sixty inteins, selected primarily from mesophilic host organisms, were screened in the S317 site in Savinase for dilution induction. The resulting iSavinase constructs were expressed in *E. coli* and lysates were tested in detergent suppression and detergent (dilution) induction assays to measure their performance under these conditions. FIG. 15 illustrates detergent suppression assay for cis-splicing iSavinase constructs. Equal amounts of total protein from iSavinase lysates were formulated in different concentrations of the detergent. Each iSavinase was constructed with a different intein in the S317 insertion site. Activity was measured for each formulated lysate and is plotted according to detergent concentration. Each bar represents the average of eight biological replicates and the error bars represent the standard deviation in the measurements. As shown in FIG. 15, significant inhibition of activity was observed when different iSavinase lysates were formulated in detergent concentrations greater than 10%. Among the different inteins tested, the Hwa-MCM1 intein showed dramatic suppression of activity, even at detergent concentrations below 5%.

Based on the positive results obtained in the detergent suppression, all of the iSavinase NICs were screened in the detergent-dilution induction assay in an effort to identify NICs that became active in a low detergent environment, despite being formulated initially at a high detergent concentration.

Figure 16:
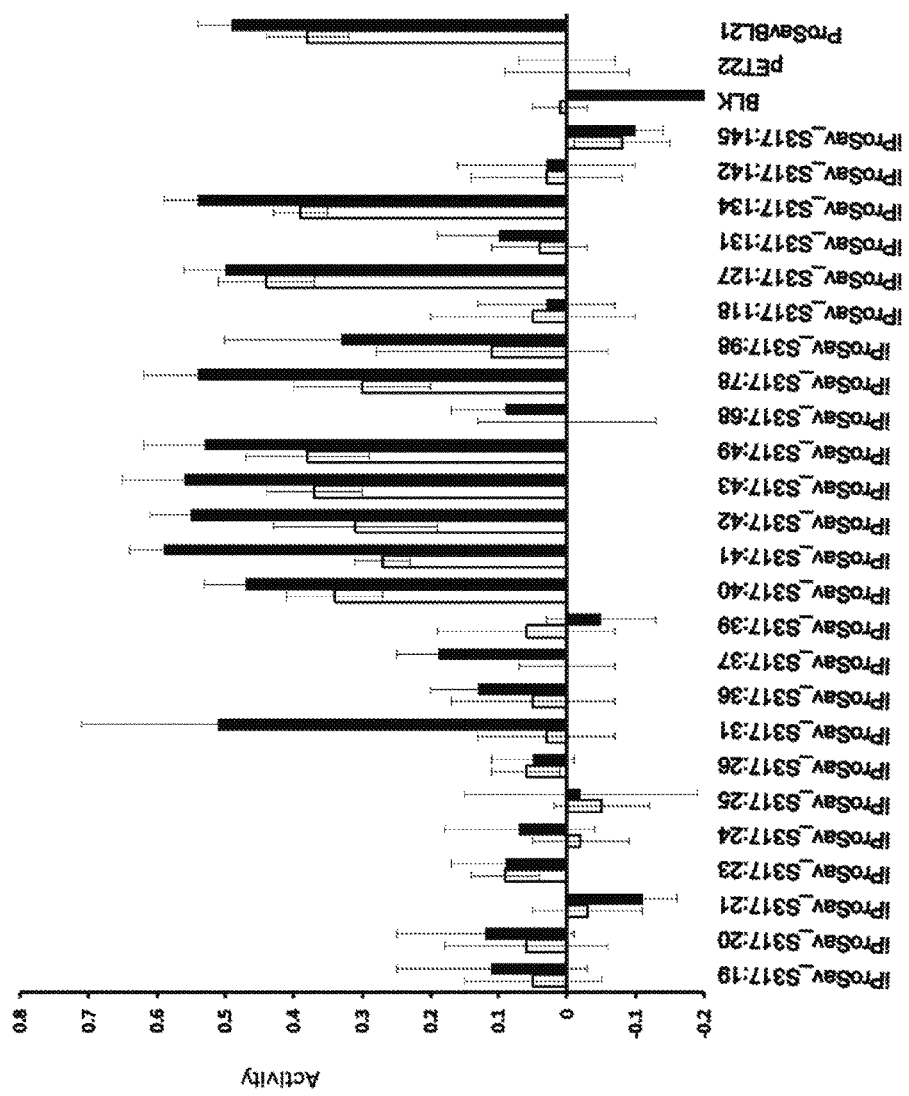
FIG. 16 illustrates a detergent dilution assay for cis-splicing iSavinase constructs.

In order to maintain an adequate protein concentration in the final assay, while still reducing the detergent concentration below 10%, aliquots of the NICs were diluted 8-fold or 400-fold into water and their activities were compared. FIG. 16 illustrates the detergent dilution assay for cis-splicing iSavinase constructs. Equal amounts of total protein from iSavinase lysates were formulated at a concentration of 25% (v/v) of the detergent. Each iSavinase molecule was diluted either 1:8 (open bar) or 1:400 (closed bar) in water and the activities were measured. Each bar represents the average of eight biological replicates and the error bars represent the standard deviation in the measurements. It was observed that the Hwa-MCM1 intein showed a significant amount of detergent dilution regulation. iSavinase:Hwa-MCM1 was selected for further development. This molecule went through a single round of mutagenesis, from which variants were selected with marginally improved regulated activity. In stability testing, the leading candidate molecule did not maintain significant activity beyond five days, and has not been expressed at a level high enough to show significant stain removal. In the dilution test, it had elevated background activity relative to the leading trans-splicing iSavinase molecules. Because this molecule splices in an aqueous environment, it was anticipated that the proteins tested in the lysates were a mixture of soluble iSavinase molecules, insoluble iSavinase molecules, and mature Savinase molecules that had already spliced. Such a mixture would be consistent with the elevated background activity observed in the presence of detergent. It was not clear whether the stability performance of the molecule was a function of its inherent properties, or the expression, purification, and formulation procedures used.

Example 23. Cold Regulated Cis-Splicing iSavinase

Cis-splicing iSavinase molecules were designed to be active in an aqueous environment and inactive in high concentrations of formulated detergent. Because these molecules would likely splice and become active during the enzyme expression, harvesting and formulation processes that occur in aqueous solutions, it was necessary to look at other stimuli that could complement detergent regulation as a method for controlling iSavinase activity. A complementary method of regulating intein splicing would enable efficient production and formulation of the precursor NIC molecules into detergent products and still provide the desired performance characteristics. Cold induction was pursued as a secondary splicing stimulus that could also serve as a proxy in identifying detergent regulated iSavinase molecules.

Yeast were selected initially as an expression host to screen for cold-inducible iSavinase molecules because yeast are very sensitive to heterologous protease expression. Working with yeast also provided rapid construction of iSavinase NIC genes using yeast's inherent ability to conduct homologous recombination between competent, co-transformed DNA fragments. Using this method, 157 different inteins were inserted into both the S135 and S317 sites that were previously selected for intein insertion yielding clones expressing iSavinase NICs of SEQ ID NOS: 140-453 and 496). Of a particular interest were intein constructs of SEQ ID NO: 634-671 encoding proteins with amino acid sequences of SEQ ID NOS: 497-535.

Figure 17:
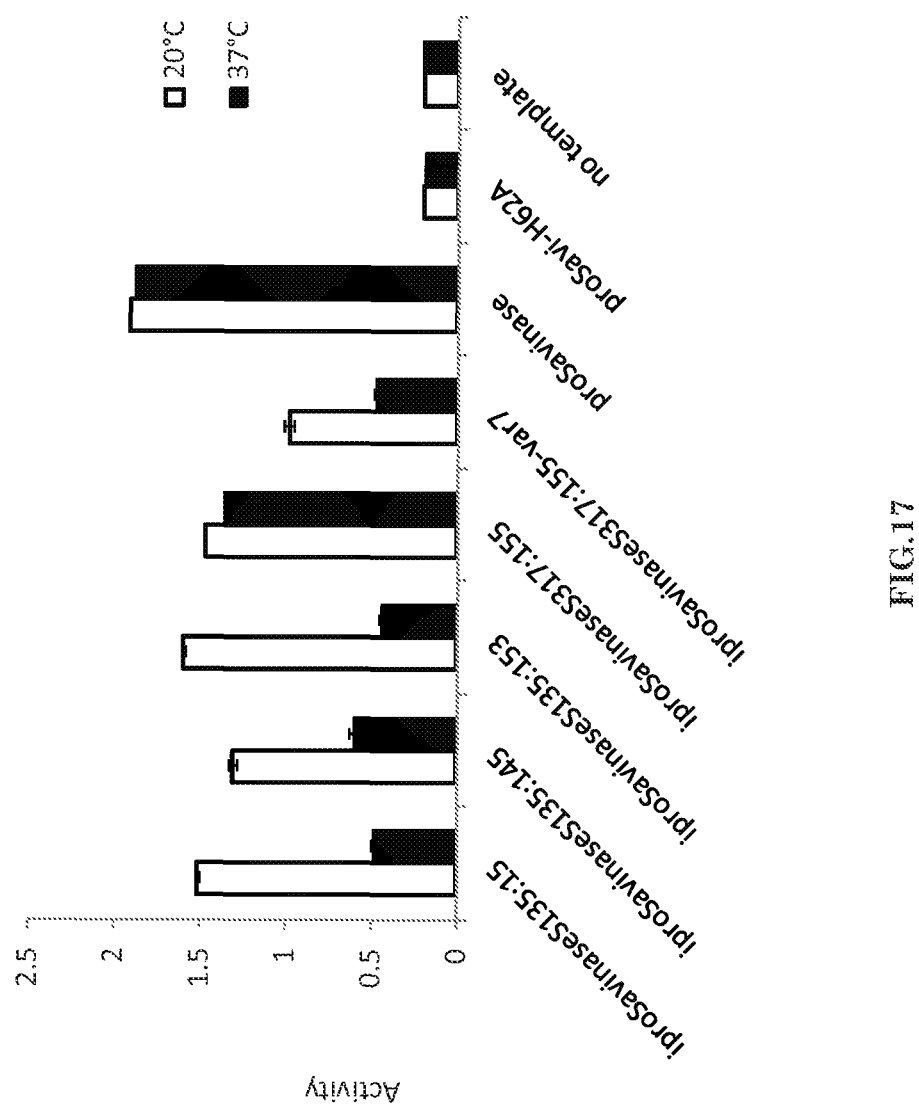
FIG. 17 illustrates a temperature induction assay for selected cis-splicing iSavinase constructs: iproSavinaseS135:15, iproSavinaseS135:145, iproSavinaseS135: 153, iproSavinaseS135:155, iproSavinaseS135:155-var7, and control contructs ProSavinase and inactive proSaviH62.

Once constructed, recombinant yeast clones were screened for growth inhibition. Yeast clones expressing iSavinase NICs were compared to a recombinant yeast strain expressing unmodified Savinase, and a recombinant yeast strain expressing a mutated, inactive iSavinase enzyme (referred to herein as H62A; SEQ ID NOS: 682), at 20° C. and 30° C. Clones that grew well at 30° C., comparable to the H62A yeast strain expressing the inactive Savinase, and grew poorly at 20° C., comparable to the yeast strain expressing unmodified (native) Savinase, were selected for further evaluation. To properly conduct this screen, eight colonies were selected for each of the 314 constructs of SEQ ID NOS: 140-453 and 496 (157 inteins inserted at two different sites in Savinase) and grown overnight in Ura⁻ glucose⁺ media under conditions where expression of the iSavinase genes was not induced. These cultures were used to inoculate replicate cultures at the same OD for growth at 20° C. and 30° C. under conditions in a Ura⁻ glactose⁺ medium where the iSavinase genes were expressed. Growth was then monitored over a 72-hour period and constructs that reproducibly demonstrated significant growth differences relative to the controls at each temperature were selected for validation of their regulated Savinase activity. Validation of growth differences was conducted using a temperature induction assay. In this assay, the iSavinase NICs were produced at 30° C. (yeast) or 37° C. (*E. coli*; this host was used to further validate the performance in yeast), harvested, and split into two aliquots. One aliquot was incubated at 20° C. for two hours, while the other aliquot was maintained at its production temperature (either 30° C. or 37° C. for two hours). After the two hour incubation, the sample incubated at 20° C. was warmed to its production temperature. Samples were taken from both aliquots, mixed with substrate, and assayed at the production temperature to compare the uninduced and induced activity of the iSavinase molecules. FIG. 17 illustrates results of the temperature induction validation assay for the selected cis-splicing iSavinase constructs: iproSavinaseS135:15 (Chth_ATPase_BIL; SEQ ID NOS: 154, 545), iproSavinaseS135:145 (Tko_Pol-2_Pko_pol-2; SEQ ID NOS: 284, 553), iproSavinaseS135:153 (Tvo_VMA; SEQ ID NOS: 292, 555), iproSavinaseS135:155 (UNC-ERS_RIR1; SEQ ID NOS: 294), iproSavinaseS135:155-var7 (Improved mutant; SEQ ID NO: 496, 633), and control contructs ProSavinase (SEQ ID NO: 57), and proSaviH62 (SEQ ID NOS: 682, 683). Selected iSavinase NICs were mutated and screened in two successive rounds of assays to further improve their performance. Referring to this figure, cold inducible Savinase activity was tested using in vitro produced protein. Shown here are representative examples of intein-modified proSavinase derived from screening proSavinase libraries with natural inteins (iproSavinaseS135:15, SEQ ID NO: 545; iproSavinaseS135:145, SEQ ID NO: 553; and iproSavinaseS135:153, SEQ ID NO: 554) and mutagenized variants (proSaviS317:155-var7, SEQ ID NO: 633). proSaviS317:Unc-ERS_RIR1 is the parent from which proSaviS317:Unc-ERS_RIR1-var7 was derived. proSavinase (unmodified Savinase) and proSaviH62A (inactivated Savinase) were used as controls. Also used as control was reaction without a DNA template. The difference in the Savinase activity between 20° C. (open bar) and 37° C. (closed bar) was notable, and enhanced for all constructs at 20° C.

FIGS. 18A-18C illustrate a time course of Savinase activity for two leading cold inducible iSavinases: iproSavinaseS135:Cth_ATPase-BIL (SEQ ID NOS: 154, 545)(FIG. 18B) and iproSavinaseS135:Mja_Klba (SEQ ID NOS: 344) (FIG. 18C) compared to unmodified proSavinase (SEQ ID NO: 57) and inactive proSavinaseH62A (SEQ ID NOS: 682, 683) (FIG. 18A). Proteins from unmodified proSavinase, inactivated Savinase (proSavH62A), and intein-modified proSavinase (proSaviS135:Cth_ATPase_BIL and proSaviS135:Mja_Kiba) were treated at 20° C. or 37° C. for 2 hrs to induce intein splicing, and then incubated with N-Succinyl-Ala-Ala-Pro-Phe p-nitroanilide at 37° C. for 1.0 hr. Absorbance (415 nm) was measured every 2 minutes for 30 min. As shown in FIGS. 18B and 18C, the activity of both iproSavinase clones was induced by a low temperature treatment (20° C.) but not in the controls (proSav and SavH62A).

Figures 19A, 19B, 19C, 19D, 19E, 19F:
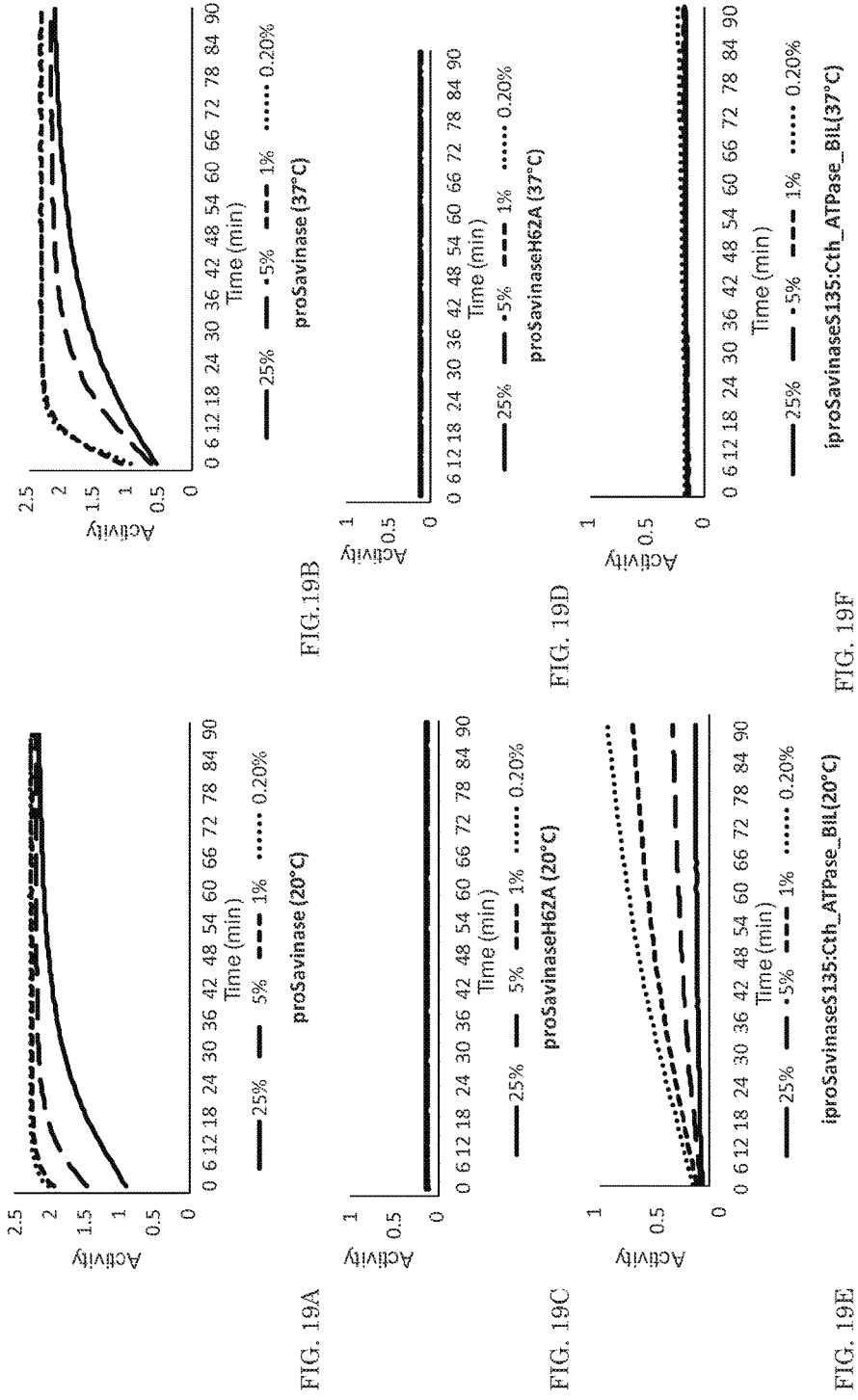
FIGS. 19A-19F illustrate detergent suppression assay for a cis-splicing iSavinase construct proSavinaseS135:Cth_ATPase_BIL and control constructs ProSavinase and inactive proSaviH62 at 20° C. and 37° C.

Selected cold-regulated iSavinase NICs were also tested for detergent-dependent regulation using the detergent suppression and induction assays at either 20° C. or 37° C. FIGS. 19A-19F show time course of Savinase activity of proSavinaseS135:Cth_ATPase_BIL (SEQ ID NOS: 154, 545) and control constructs ProSavinase (SEQ ID NO: 57) and inactive proSaviH62 (SEQ ID NOS: 682, 683) in detergent formulations. Because of difficulties in expressing certain NIC molecules to significant levels in either the yeast or *E. coli* systems, an in vitro transcription and translation (IVTT) method was used to produce the NICs which were tested for detergent-dependent regulation. Proteins from unmodified proSavinase (FIGS. 19A and 19B), inactivated Savinase (SavH62A; FIGS. 19C and 19D), and intein-modified proSavinase (proSaviS135:Cth_ATPase_BIL; FIGS. 19E and 19F) were mixed with detergent formulation of various concentrations to make a final detergent concentration of 25%, 5%, 1% and 0.2%, followed by treatment at 20° C. or 37° C. for 2 hrs to induce intein splicing, and then incubated with the N-Succinyl-Ala-Ala-Pro-Phe p-nitroanilide substrate at 37° C. Absorbance (405 nm) was measured every 2 minutes for 90 min. The activity of iproSavinaseS135:Cth_ATPase_BIL varied in a detergent concentration-dependent manner, with no activity in high concentration (25%) detergent formulation and high activity in low concentration (0.2%) detergent formulation. The activity was also induced by a 2 hr/20° C. treatment. Protease activity in the controls (proSavinase and proSavinaseH62A), however, remained unchanged in different concentration of detergent formulation. It was also observed that high concentration (higher or equal to 25%) detergent formulation suppress intein splicing. This behavior was consistent with the temperature-regulated protease activity that was previously established for this molecule (FIG. 17).

Figures 20A, 20B, 20C, 20D:
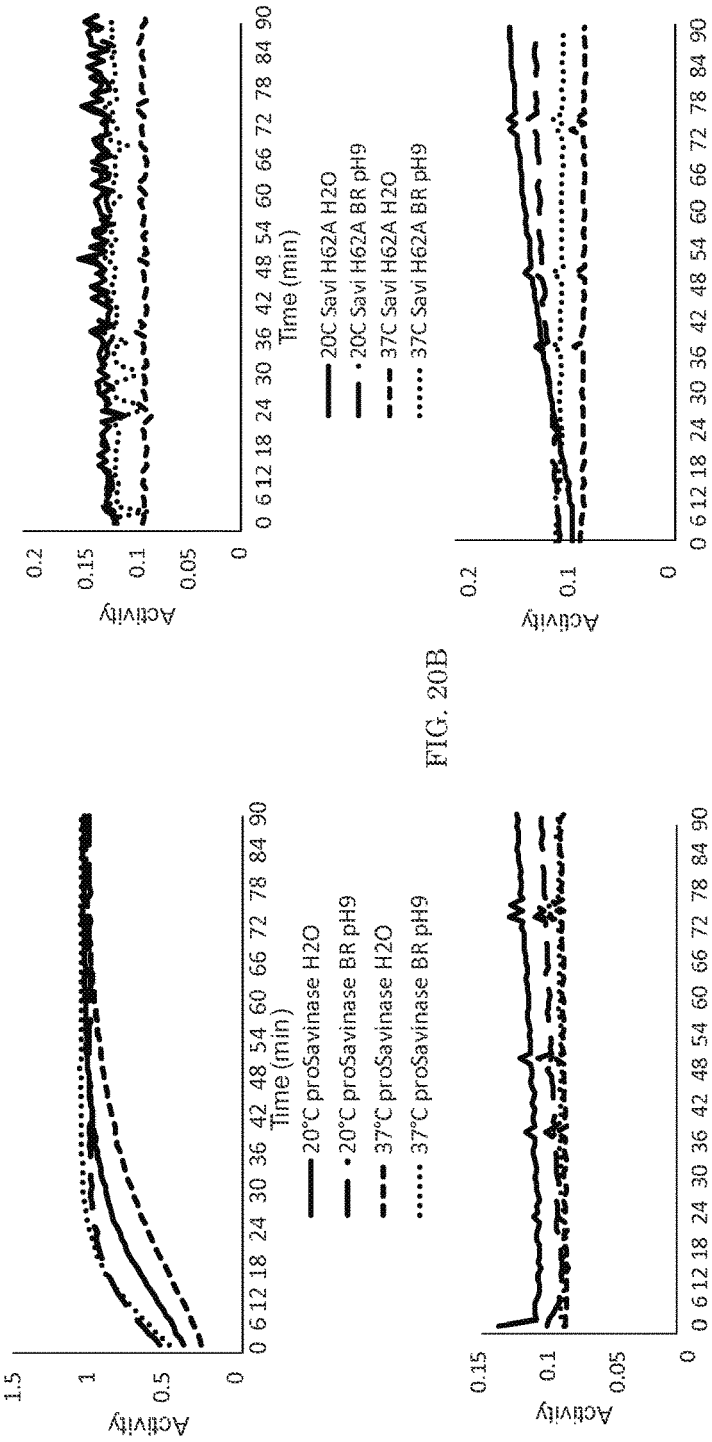
FIGS. 20A-20D illustrate detergent suppression assay for selected cis-splicing iSavinase constructs: ProSavinase, proSaviH62, AS15 and AS48 at 20° C. and 37° C.

FIGS. 20A-20D show time course of Savinase activity in detergent-dilution induction assay for the cold induced, cis-splicing iSavinase constructs iproSavinaseS135:Cth_ATPase_BIL (shown as S135:15FIG. 20C), iproSavinaseS135:Mja_Klba (shown as S135:48, FIG. 20C), compared to unmodified proSavinase (FIG. 20A) and inactivate proSavinase H62A (FIG. 20B) at 20° C. and 37° C. Equal amount of proteins from unmodified proSavinase, inactivated Savinase (proSavinaseH62A), and intein-modified proSavinase (proSaviS135:Cth_ATPase_BIL, and proSaviS135:Mja_Kiba) were separately mixed with 37° C. detergent formulation to a final concentration of 25% detergent, followed by dilution with either $H_2O$ or BR buffer (pH 9.0) which was set at either 20° C. or 37° C. and maintained at that condition for 2 hrs to induce intein splicing, and then incubated with the N-Succinyl-Ala-Ala-Pro-Phe p-nitroanilide substrate at 37° C. Absorbance (OD 415 nm) was measured every 2 minutes for 90 min. Savinase activity increased upon dilution either in $H_2O$ or BR buffer (to a less degree) at 20° C., yet remained unchanged at 37° C. This trend was only observed in intein-modified proSavinase (S135:15 in FIG. 20C and S135:48 in FIG. 20D) and not in the controls (proSavinase in FIG. 20A and SavH62A in FIG. 20B). It is suggested that dilution with $H_2O$ intein splicing from suppression by high concentration detergent. In FIG. 20C, S135:15 represents construct proSavinaseS135:Cth_ATPase_BIL. In FIG. 20D, S135:48 represents construct proSavinaseS135:Mja_Kiba. Of the molecules tested, only the iproSavinaseS135:48 showed some level of detergent-dilution regulation. It was observed that all of the iSavinase NIC molecules demonstrated significant cold-temperature regulation and were strongly inhibited by high concentrations of the detergent formulation.

Example 23. Methods Development

Protease screening assays and various analytical methods were developed to test enzyme activity, and several different expression systems for enzyme screening and production were developed.

An assay for screening engineered iSavinase molecules was developed using agar plates, wherein the agar medium contains a colorimetric substrate that indicates the presence of active protease when it is cleaved. These plates were initially used in the screening process to quickly assess constructed NICs by scoring microbial colonies based on their activity at different temperatures. While this assay was not quantitative, it enabled rapid library screening.

Quantitative assays that use a soluble substrate and can measure activity pre- and post-splicing were also developed. These assays have been implemented using automation in both 96- and 384-well formats. For one of the protease assays, the substrate Suc-Phe-Ala-Ala-Phe-4NA was used that has a published $k_{cat}/K_m$ value greater than 10× that of the Suc-Ala-Ala-Pro-Phe-4NA commonly used for subtilisin-like alkaline proteases. This higher specificity substrate was experimentally determined to give the most robust signal-to-noise ratios in control experiments, and made possible a more robust automated screen for Savinase. Both substrates could be used to directly measure protease activity in clear, colorless, detergent formulations. These formulations were important in screening molecules and determining their activity directly in the formulation. In addition, epitope specific and polyclonal antibodies were used against the unmodified proSavinase that were used in Western analysis.

Initially, *E. coli* and *B. subtilis* expression systems were developed. The *E. coli* system was used for either cytoplasmic or periplasmic expression, while the *B. subtilis* based system was used for secretion of the proteins. While the *Bacillus* system has relatively low throughput, it may be useful for production of candidate enzymes in the future. High throughput screening systems were developed using *E. coli*. Unmodified Savinase, proSavinase and the intein-modified forms of the enzyme were expressed using these systems. In addition, a yeast based expression system was developed. Finally, it was shown that IVTT could be used effectively in making iSavinase and unmodified Savinase molecules. Combined, these different expression systems provided screening capacity and protein production capability to deliver an intein-modified Savinase that meets detergent applications metrics.

iSavinase-NI and iSavinase-IC expression. The trans-splicing iSavinase pair iSav-NI and iSav-IC was separately expressed in *E. coli*. Expression was driven by T7 promoter and inducible by the IPTG in the pET-Duet1 vector and the *E. coli* strain BL21-Gold (DE3). The unmodified proSavinase was used as a positive control and the empty vector was used as a negative control.

Overnight cultures were grown in LB medium supplemented with 100 mg/L ampicillin. Aliquots were inoculated into fresh media and grown to $OD_{600}$ 0.6 before the IPTG was added. Cells were harvested by centrifugation 3 hours later.

Glycerol stocks of trans-splicing constructs in *E. coli* were as follows: pETDuet1-iSav-NI-GG-6His in BL21 Gold (DE3) (iSav-NI); pETDuet1-iSav-IC-Sumo-6His in BL21 Gold (DE3) (iSav-IC); pETDuet1-proSavinase in BL21 Gold (DE3) (positive control); and pETduet1 in BL21 Gold (DE3) (negative control). Trans-splicing constructs in *E. coli* were streaked out of glycerol stocks onto LB+carb 100 mg/L agar plates and incubated at 30° C. overnight. Plates were removed from 30° C. and used immediately to inoculate liquid cultures or stored at 4° C. for up to 1 week. Four milliliters of LB Carb 100 mg/L media were aliquoted into four 17×100 mm polystyrene tubes or similar. Single colonies from agar plates were inoculated into 4 mL starter cultures and incubated at 30° C., 300 rpm, overnight. 2.5 mL of each the overnight starter cultures were inoculated into 100 ml fresh medium (40× dilution) and incubated at 30° C. on a shaker at 300 rpm until OD$_{600}$ 0.6. IPTG was added to a final concentration of 0.5 mM. Cultures were further incubated at 30° C./300 rpm for 3 hr. 30 mL aliquots were taken and cells were pelleted at 3,000 g at 15° C. for 10 min. Tubes were kept on ice and supernatant was discarded. The protein preparation was started immediately as described in "iSavinase-NI, iSavinase-IC harvesting," or cell pellets were stored in the 50 ml Falcon tubes at −8° C.

Preparation of mTSB+Ca Buffer.

The modified Trans Splicing Buffer (TSB) included 50 mM Tris base (Trizma™), 150 mM NaCl, 2 mM CaCl$_2$, 1 mM DTT (dithiothreitol). TSB with 2 mM calcium (mTSB+Ca) was used in trans-splicing enzyme assays, in cell lysis buffer and in the dialysis of iSavinase NI and IC solubilized cell lysates.

iSavinase-NI and iSavinase-IC harvesting.

The *E. coli* expressed trans-splicing proteins (iSavinase-NI and -IC) were harvested. While iSavinase-NI is partially soluble, -IC is mostly insoluble. To solubilize the trans-splicing proteins, cell lysates were solubilized in 6M urea. Urea was removed by overnight dialysis and the soluble protein fractions were harvested.

800 μL Lysis Buffer (400 μL of Fastbreak Cell Lysis Reagent 10×, #2013-10-13 (Promega) (10×) in 3600 μL mTSB+Ca, and 8 μl Benzonase (Nuclease HC, #71205-3, Novagen) was added to the 30 mL cell pellet in 50 mL conical Falcon tube, vortexed and pipetted until the pellet was completely suspended. Leave cells at room temperature for 25 min. 1500 μl of 10M urea was added in mTSB+Ca with a lysate to urea ratio of 4:6, (v/v) and incubated at 300 rpm/25° C./120 min. Each urea solubilized lysate was transferred into two 1.5 mL microtubes. Lysates were clarified at 5000 g/5 min. The supernatant containing the urea solublized protein fraction was transferred into a Tube-O-Dialyzer Medi 4 kDa MWCO tube (17×100 mm polystyrene tubes #1485-2810; USA Scientific) and dialyzed against mTSB+Ca at room temperature, overnight.

Dialysis buffer was changed and dialysis continued at room temp for 2 hrs. The dialysis tubes were gently vortexed with the membrane face down, to dislodge proteins from the membrane. Samples were transferred from the Tube-O-Dialyzer to two 1.5 ml microtubes and spinned at 5000 g/5 min. Supernatant was harvested into 15 mL acetone resistant conical polypropylene tubes (Falcon). Samples were kept at room temperature. Trans-splicing activity of the solubilized iSav-NI and iSav-IC lysates was further tested.

Detergent Formulation of Purified iSav-NI and iSav-IC.

Purified iSavinase-NI (MW. 42 kDa) and iSavinase-IC (MW. 27 kDa) were reconstituted in mTSB-Ca+10 mM DTT and solubilized in a detergent in equimolar amounts. These were mixed using the molar mass ratio of NI:IC=1.6:1. Briefly, 50% (v/v) solution of a detergent MTS24 (Maradona10) in water was prepared. iSavinase-NI (3.8 mg/mL in 150 mM NaCl, 50 mM MES pH 6.3, 40% glycerol) and -IC (2.59 mg/mL in 10 mM Tris pH 8.0, 40% glycerol) were reconstituted in mTSB-Ca+10mMDTT. In a PCR tube, 22 μL (~84 μg) iSavinase-NI and 22 μL mTSB-Ca+10 mM DTT were mixed by pipetting. The mixture was briefly spinned to remove air bubbles. In a separate PCT tube, 22 μL (~57 μg) iSavinase-IC was mixed by pipetting with 22 μL mTSB-Ca+10 mM DTT and briefly spinned to remove air bubbles. The mixtures were incubated at room temperature for 30 minutes. iSavinase-NI and -IC were formulated into detergent in four different orders of assembly. Formulation was done into PCR tubes with thorough mixing and waiting ~1 min after addition of each component. Detergent final concentration was adjusted to 25%. Formulated samples were: 10 μL 50% detergent+5 μL NI+5 μL IC; 10 μL 50% detergent+5 μL IC+5 μL NI; 5 μL IC+10 μL 50% detergent+5 μL NI; 5 μL NI+10 μL 50% detergent+5 μL IC; 10 μL 50% detergent+5 μL NI+5 μL mTSB (control); 10 μL 50% detergent+5 μL IC+5 μL mTSB (control). The tubes were briefly spinned and incubated at room temperature overnight to promote assembly of trans-splicing pairs. The detergent dilution assay was run on 5 μL aliquots (see Detergent dilution assay of purified formulated trans splicing iSavinase).

Trans Splicing iSavinase Detergent Suppression and Activation in Water.

Trans-splicing activity in water and detergent was evaluated. In water, trans-splicing restored Savinase activity. In detergent, trans-splicing was suppressed and there was no detectable protease activity.

Purified iSavinase-NI in 150 mM NaCl, 50 mM MES, pH 6.3, 40% glycerol included the following samples: 250 μL of iSavinase-NI (2) (2.6 mg/ml; monomer); 300 μL iSavinase-NI (3) (3.8 mg/mL; monomer); 800 μL of iSavinase-NI (4) (8.6 mg/mL; dimmer); and 800 μL of iSavinase-NI (5) (7.1 mg/mL).

Purified iSavinase-IC in 10 mM Tris pH8.0, 40% glycerol included 11 mL of iSavinase-IC (2.59 mg/mL). The pET Duet1 proSavinase was used as a positive control and the pET-Duet1 empty vector as a negative control.

The 3× purified protein samples were prepared in the pre-labeled PCR tubes as follows: NI2 (16 μL of iSav-NI-2 sample in 14 μL mTSB+Ca+DTT buffer); NI3 (11 μL iSav-NI-3 in 19 μL mTSB+Ca+DTT buffer); NI4 (5 μl iSav-NI-4 in 5 L iSav-NI-4 buffer); NI5 (6 μL iSav-NI-5 in 24 μL mTSB+Ca+DTT buffer); IC (10 μL iSav-IC in 20 μL mTSB+Ca+DTT buffer); "−" (10 μL pET-DUET in 20 μL mTSB+Ca+DTT buffer) and "+" (10 μL Savinase in 20 μL mTSB+Ca+DTT buffer). Samples were kept at room temperature for 30 min. Paper well templates were used to organize sample placement before beginning assay.

Two conditions were tested.

(1) Activation in Water Test (H$_2$O+NI+IC): The PCR tubes were pre-loaded with dH$_2$O and the earlier assembled 3× purified proteins were added to a final concentration of 1×. 30 μL samples included 24.0 μL of dH$_2$O and 3 μl of each of 3× Protein 1 and 3× Protein 2.

(2) Detergent Suppression Test (100% detergent+NI+IC): The PCR tubes were pre-loaded with 100% detergent and the earlier assembled 3× purified proteins were added to a final concentration of 1×. 30 μL samples included 24.0 μL of 100% detergent and 3 μL of each of 3× Protein 1 and 3× Protein 2. Samples were incubated at 37° C. for 30 minutes and then loaded onto the Savinase assay plate, a 96 well flat bottom plate (Costar 9017: flat bottom, medium binding). For the activation in water test, the samples were transferred into wells preloaded with 60 μL H2O to each of 6 wells. For the Detergent Suppression Test, the samples were transferred into wells preloaded with 60 μL 100% detergent to each of 6 wells. 10 μL 1×BR buffer, pH 9.0, and 100 μL 2× substrate (500 μM Succinyl-FAAF-pNA in 20% DMSO) were added to each well. The spectrophotometer was set up for kinetic read. The activity of the samples was measured kinetically by recording absorbance at 400 nm once a minute for up to two hours.

Detergent Suppression of Trans Splicing in Cell Lysate.

Detergent suppression of trans-splicing using cell lysates of iSavinase-NI and -IC was evaluated. Cell lysates of iSavinase-NI and -IC were mixed, detergent was added and samples were assayed for Savinase activity. Briefly, 60 µL 100% detergent was preloaded into 5 wells of 96 well flat bottom plate. Cell lysates were added as follows: 15 µL NI+15 µL negative control (empty vector cell lysate); 15 µL IC+15 µL negative control; 15 µL NI+15 µL IC; 30 µL negative control and 15 µL positive control (Savinase) +15 µL negative control (empty vector lysate). Plate was incubated at 37° C. for 1 hour. 10 µL 1× BR buffer pH 9.0, and 100 µL 2× substrate (500 µM Succinyl-FAAF-pNA in 20% DMSO) were added to each well. The activity was kinetically measured by recording absorbance at 400 nm once a minute for two hours.

Restoration of Savinase Activity from Purified Inactive Parts by Trans Splicing.

Restoration of Savinase activity by trans-splicing of iSavinase-NI (MW. 42 kDa) and -IC (MW. 27 kDa) was demonstrated. Savinase was split to N- and C-terminal parts and trans-splicing intein were attached to both parts to generate iSavinase-NI and -IC. Both iSavinase-NI and -IC lacked protease activity. Mixing the two inactive parts triggered trans-splicing, traceless joining of the N- and C-terminal parts of the Savinase and restored enzyme activity. For efficient trans-splicing equimolar amounts of NI and IC were mixed with a mass ratio of NI:IC=1.6:1.

Purified iSavinase-NI in 150 mM NaCl, 50 mM MES, pH 6.3, 40% glycerol included the following samples: 250 µL of iSavinase-NI (2) (2.6 mg/mL; monomer); 300 µL iSavinase-NI (3) (3.8 mg/mL; monomer); 800 µL of iSavinase-NI (4) (8.6 mg/mL; dimer); and 800 µL of iSavinase-NI (5) (7.1 mg/mL).

Purified iSavinase-IC in 10 mM Tris pH8.0, 40% glycerol included 11 mL of iSavinase-IC (2.59 mg/mL). The pET Duet1 proSavinase was used as a positive control and the pET-Duet1 empty vector as a negative control.

Briefly, purified proteins and mTSB+Ca+DTT were combined in the order indicated in the pre-labeled (1-11) PCR tubes as follows: (1) 1.0 µL iSav-IC in 29.0 µL mTSB+Ca+DTT; (2) 1.6 µL iSav-NI-2 in 28.4 µL mTSB+Ca+DTT; (3) 1.1 µL iSav-NI-3 in 28.9 µL mTSB+Ca+DTT; (4) 0.5 µL iSav-NI-4 in 29.5 µL mTSB+Ca+DTT; (5) 0.6 µL iSav-NI-5 in 29.4 µL mTSB+Ca+DTT; (6) 1.0 µL iSav-IC and 1.6 µL iSav-NI-2 in 27.4 µL mTSB+Ca+DTT; (7) 1.0 µL iSav-IC and 1.1 µL iSav-NI-3 in 27.9 µL mTSB+Ca+DTT; (8) 1.0 µL iSav-IC and 0.5 µL iSav-NI-4 in 28.5 µL mTSB+Ca+DTT; (9) 1.0 µL iSav-IC and 0.6 µL iSav-NI-5 in 28.4 µL mTSB+Ca+DTT; (10) 2.0 µL pET-DUET in 28.0 µL mTSB+Ca+DTT; and (11) 1.0 µL pET-DUET and 1.0 µl Savinase in 29.0 µL mTSB+Ca+DTT. Samples were incubated at 37° C. for 30 minutes. The Savinase assay plate was prepared and 11 wells were preloaded with 70 µL 1×BR buffer pH 9.0. Samples were transferred to the Savinase assay plate. 100 µL 2× substrate (500 µM Succinyl-FAAF-pNA in 20% DMSO) was added to each well. The activity was kinetically measured by recording absorbance at 400 nm once a minute for up to two hours.

iSavinase-NI and iSavinase-IC Lysate Formulation.

The trans-splicing iSavinase-NI and iSavinase-IC were concentrated and co-solubilized with the detergent. iSavinase-NI and -IC were separately precipitated with acetone, the acetone suspensions of NI and IC were mixed, pelleted and solubilized into the detergent. It was important to validate trans splicing activity of the iSavinase-NI and -IC lysates before formulation. Starting material was urea solubilized clarified lysate in mTSB-Ca. See iSav-NI, iSav-IC harvesting. Samples were as follows: iSavinase-NI; iSavinase-IC; proSavinase (positive control) and pET Duet1 empty vector (negative control).

The cell lysates prepared from 30 ml induction culture cell pellets were solubilized in freshly made urea, refolded, clarified and used as a starting material (see iSavinase-NI, iSavinase-IC harvesting). Samples were as follows: iSavinase-NI; iSavinase-IC; proSavinase (positive control) and the pET Duet1 empty vector (negative control). Lysate volumes were measured by pipetting and four volumes of −80° C. acetone in 1 ml aliquots were added to one volume of cell lysate to form precipitates. Samples incubated at −80° C. for one hour. The tubes warmed up at room temperature for 10 minutes to allow the precipitates to settle to the bottom. The content of each tube was divided to three equal volume aliquots into 1.5 mL microtubes. Each micro tube had proteins from 10 mL induction culture and was formulated separately. Acetone precipitates of the four samples were divided in 12 microtubes. The content of one microtube of iSav-NI was added to one microtube of the iSav-IC and vortexed gently to mix.

This procedure was repeated with a second set of iSav-NI and -IC. Samples of the second set were as follows: iSavinase NI+IC (trans-splicing mix); iSavinase NI (control); iSavinase-IC (control); proSavinase (positive control); and pET Duet1 empty vector (negative control). The samples were spinned at 13,000 rpm for 10 min at room temperature. Acetone was added to the samples and evaporated. 400 µL of the detergent was added to the side of the tube then mixed with the content by pipetting. Samples were incubated at room temperature overnight to continue solubilizing the pellet and were stored at room temperature. Detergent Dilution Assay of Formulated Cell Lysates of Trans Splicing iSavinase. The activity of formulated tran-splicing iSavinaseNI+IC cell lysates was evaluated in water and in the detergent.

Two sets of plate well were labeled for water dilution and detergent dilution. Each set has four wells for NI+IC, and one well for the positive (Savinase) and negative (pET-DUET empty vector) controls. NI+IC wells were preloaded with 80, 85, 87.5 and 88.75 µL of water or detergent. The control wells were preloaded with 88 µL water or detergent. Ten, 5, 2.5, or 1.25 µL of the formulated iSavinase NI+IC was added to the NI+IC wells to a final sample volume of 90 TwioL. 2 µL formulated Savinase was added to the positive control wells. Two microliters of the formulated empty vector lysate was added to the negative control well. Ten microliters of 1×BR buffer, pH 9.0, and 100 µL 2× substrate (500 µM Succinyl-FAAF-pNA in 20% DMSO) were added to each well. The activity was kinetically measured by recording absorbance at 400 nm once a minute for two hours.

iSavinase-NI and -IC Trans Splicing Assay for Cell Lysates.

Trans splicing activity of iSavinase-NI and -IC was evaluated using solubilized clarified cell lysates. The following cell lysates were used: iSavinase-NI and -IC clarified cell lysates, as well as cell lysates of the positive (pET-Duet1 proSavinase) and negative (pET-Duet1 empty vector) controls. Cell lysates were combined in flat bottom plate as follows: 15 µL NI+15 µL empty vector; 15 µL IC+15 µL empty vector; 15 µL NI+15 µL IC; 30 µL empty vector and 15 µL Savinase+15 µL empty vector. Plate was covered with foil seal and incubated for 1 hour at 37° C. 70 µL 1×BR buffer, pH 9.0, was added to each sample to bring volume to 100 µL. One hundred microliters of 2× substrate was added to each well. The activity was kinetically measured by recording absorbance at 400 nm once a minute for two hours.

Cis-Splicing iSavinase Expression in *E. coli*.

Cis-splicing intein modified iSavinaseSS317:31:Hwa and control constructs were expressed in *E. coli*. To reduce cytotoxicity, expression was targeted to the periplasmic space. *E. coli* BL21(DE3) cells containing pET22 constructs of cis-splicing Savinases were assigned as follows: pET22 empty vector control; proSavinase; iproSavinase S317:mT-thEU59; iproSavinaseS317:31:Hwa_MCM-1; iproSavinase S317: 31: HwaA (splicing disabled intein control); iproSavinase S317:31:Hwa_var (35.G21); and iproSavinase S317:31:Hwa_var (22.C3). Glycerol stocks were stored at −80° C.

Clones were streaked from glycerol stocks to agar plates (LB supplemented with glucose 0.5%, carbenicillin 100 mg/L) and single colonies were inoculated into 6 mL of liquid Overnight Express™ Instant TB Medium, also called "Auto Induction Medium" (AIM) (Novagen, EMD Millipore) and incubated at 20° C., 300 rpm for 48 hrs. Cells were pelleted at 4000 g for 10 min and supernatant was discarded.

*E. coli* cell lysates were formulated in a detergent to demonstrate detergent suppression of Savinase activity and recovery of the activity upon dilution with water. Briefly, 100 µL aliquots of lysates were dispensed into a round bottom 96 well plate. 100 µL of 50, 20, 10, 4, 2% (v/v) detergent solution in 1×CCH (1×CHES-Citrate-HEPES) buffer, pH 9.0, were added and incubated at 20° C. for 2 hrs.

Formulated lysates were assayed for Savinase activity in the detergent and after dilution into water.

Lysate plates were removed from 20° C. and 25 µl of the detergent-lysate were transferred into the 175 µL preloaded CCH buffer, pH 9.0, or 175 L of 25, 10, 5, 2, or 1% detergent formulation in CCH buffer, pH 9.0. Samples were mixed by pipetting. Plate reader was set up at 37° C., and absorbance measured at 400 nm. Enzyme assay was performed as follows. One hundred microliters of 500 µM FAAF-pNA (N-succinyl-FAAF-pNA; Bachem #L1675; MW 674.71) substrate stock solution was added into flat bottom 96 well plates, and mixed. One hundred microliters samples diluted in detergent or in CCH buffer, pH 9.0 by pipetting. Absorbance readings were taken at 400 nm over 15-20 min.

Cold Inducible Savinase Activity Assay.

PCR reaction components were assembled in the following order: 33.5 µL of nuclease-free water, 10 µL of 5× Phusion HF buffer, 1 µL of 10 mM dNTPs, 2 µL of 10 µM forward primer, 2 µL of 10 µM reverse primer, 1 µL of template DNA, 0.5 µL Phusion Hot Start DNA Polymerase (Thermo Scientific, cat#F-540L) per 50 µL reaction. All components were mixed and briefly centrifuged prior to use. DNA minipreps (200 ng/µL) of constructs harboring Pro-Savinase NICs were used as PCR template. Thermocycling conditions included initial denaturation at 98° C. for 30 sec, followed by 28 cycles of 98° C. 10 sec, 65° C. 25 sec, 72° C. 1.5 min, and 72° C. 5 min and hold at 4° C.

PCR product was purified using QIAquick PCR purification kit (qiagen). Five volumes of Buffer PB were added to 1 volume of product and mixed, applied to the QIAquick column and centrifuged for 30-60 sec. Flow-through was discarded, the QIAquick column was washed with 750 µL Wash Buffer PE and centrifuged for 30-60 sec. To elute DNA, 50 µL of Elution Buffer was added to the center of the QIAquick membrane, the column was left undisturbed for 1 min before centrifugation for 1 min. To estimate the DNA concentration, 2 µL of purified PCR products was run against 2 µL of 2-log DNA ladder on 1% agarose gel.

Protein synthesis was performed using PURExpress in vitro protein synthesis kit (New England Biolabs, catalog #E6800S). All reagents were kept on ice during the assembly of reactions. Solutions A and B were thawed on ice, and pulse-spinned in a microfuge. The twenty microliter reaction was assembled on ice in a new PCR tube in the following order: 8 µL solution A, 6 µL of solution B, 6-X µL H$_2$O and X µL templated DNA. The reaction components were mixed gently and pulse-spinned in microfuge. The mixture was incubated at 30° C. for 2 hours and the reaction was stopped by mixing with 60 µL of 1× BR Buffer, pH9.0 (pre-warmed to 30° C.). 40 µL protein mixture was transferred to a new PCR tube.

To mobilize intein, 40 µL of protein mixture was incubated either at 20° C. or 37° C. for 2 hours followed by additional 10 min at 37° C. Forty microliters of 2× substrate stock (pNA substrate; Bachem, cat#L1675) pre-warmed to 37° C. were mixed with the sample. After incubating at 37° C. for h, absorbance was measured at 400 nm.

Screening for Cold-Inducible Savinases in Yeast

It was demonstrated that savinase caused cyto-toxicity when expressed in *E. coli* and in yeast. This selective feature was used to develop cold-inducible intein-modified Savinase. Besides high sensitivity to Savinase toxicity, yeast can grow at lower temperatures that are ideal for cold inducible intein splicing, and possesses high fidelity/efficiency homologous recombination that allows high throughput library screening.

Yeast Transformation

Yeast expression vector pSavi-Y 135/317 was generated by inserting pro-Savinase into p416 GALL vector (SEQ ID NOS: 630) and by introducing BamHI recognition sequence in savinase at S135 and S317 sites. It was constructed by gap-repair cloning of the pro-Savinase gene into p416 GALL down-stream of GalL promoter, where expression of pro-Savinase is turned on by galactose and turned off by glucose. pSaviY135 carries pro-Savinase gene with BamHI recognition sequence at its S135 site (SEQ ID NOS: 631), while pSaviY317 carries pro-Savinase gene with BamHI sequence at its S317 site (SEQ ID NOS: SEQ ID NOS: 632). The vector DNA is routinely prepared from *E. coli* overnight cultures in LB (Luria-Bertani) medium containing ampicillin, according to QIAprep Spin Miniprep Kit Protocol (Qiagen).

For library construction, BamHI-linearized vector DNA was co-transformed with PCR amplified intein DNA (UncERS_RIR1 and Sce_VMA) and transformants were plated on synthetic medium plates lacking Uracil (Ura-) but with glucose or galactose. Yeast strain BY4741 was used to demonstrate the phenotype of growth inhibition (cytotoxicity) conferred by heterologous expression of pro-Savinase gene, which was developed into a high throughput screening assay for Savinase activity resulting from intein splicing.

Yeast transformation is routinely carried out with the LiAc/SS carrier DNA/PEG method. Two g of BamHI-linearized pSaviY135/317 and 6 g of PCR-generated intein variants were mixed with 400 µL freshly made yeast competent cells and delivered at 2.5 kV and 25 µF (typical time constant ranges from 3.0 to 4.5 milliseconds) in a GenePulser cuvette (0.2 cm gap). This electroporation method allows for efficient generation of large libraries with up to 4×10$^7$ variants.

Following electroporation, yeast transformation mix was plated out on −Ura agar plates that contain 2% galactose (which turns ON the GalL promoter) and incubated at 30° C. for up to 3 days. Yeast cells carrying variants that constitutively splice at 30° C. will accumulate active Savinase, resulting in growth inhibition or host cell elimination. Consequently, the resulting sub-library is enriched for yeast transformants whose splicing is suppressed at 30° C. This procedure generally yields about 100 fold enrichment.

Savinase activity-associated yeast growth inhibition was developed into a cell-based selection assay, which was employed in the primary library screening to identify cold inducible iSavinase. Following library enrichment in 2% galactose, yeast transformants were individually picked as colonies and inoculated into 0.5 or 0.1 mL of Ura minus selection media containing 2% glucose. After incubation at 30° C. for 2 days, the saturated yeast culture ($OD_{600}$3~4) was sub-cultured (100 fold dilution) in −Ura selection media containing 2% galactose, in 2 sets of 96- or 384-well plates, with one set incubated at 20° C. and the other set at 30° C. for up to 5 days. Cell growth was monitored daily by measuring $OD_{600}$. Throughout the test, an unmodified pro-Savinase and its mutant H62A Savinase constructs were used as controls. Cells expressing unmodified pro-Savinase grew poorly at 20° C. and 30° C. and those expressing inactive H62A Savinase grew well at both temperatures. Yeast variants that grew normally at 30° C., similar to H62A expressing cells, yet very slowly at 20° C., similar to unmodified pro-Savinase, were scored as "positive". For verification purpose, positive clones were then cherry-picked and re-assessed for the growth phenotype at 20° C. and 37° C. Following verification, 54 clones of Unc-ERS_RIR1 variants and 60 clones of Sce_VMA variants were prioritized as "HITs" for further evaluation and lead candidate identification on a secondary (activity) assay. Vector DNAs were prepared and submitted for sequencing analysis of mutant intein variants.

Natural Intein Screening in Savinase 157 inteins were PCR amplified and inserted into both S135 and S317 sites by yeast homologous recombination, in which equal mole of BamHI-linearized pSavi-Y and PCR amplified intein were mixed with competent yeast cells along with SS-DNA, PEG and LiCl. After incubation at 30° C. for 30 min, the mixture was heat-shocked at 42° C. for 15 min. Cell pellet was re-suspended in $H_2O$, and plated out on selective agar plates with galactose and left at 30° C. for two days. Eight colonies were grown in non-selective glucose liquid medium to saturation (30° C., 2 days) from which small aliquot (2.5 µL) was inoculated into replicates of selective galactose medium, with one set grown without shaking at 30° C. and another set 20° C. before taking $OD_{590nm}$ measurement for all samples. Clones that grow normally at 30° C. yet grow very slowly at 20° C. were picked up for further testing.

Mutagenized Intein Screening in Savinase

Several inteins (Kra_DnaB, Pho_IF2, Pho_r-Gyr, Unc-ERS_RIR1, and SceVMA) were PCR mutagenized, inserted into Savinase at S317 site while sceVMA intein was also inserted in Savinase at S135 sit via yeast homologous recombination. High titer yeast libraries were enriched in selective galactose liquid medium at 30° C. 250 rpm overnight to eliminate intein-modified Savinase variants that constitutively splice at 30° C. Variants in which intein did not splice at 30° C. were able to grow colonies on galactose agar plates.

Individual colonies were grown in selective glucose liquid medium to saturation (30° C., 48 hrs) from which small aliquot (2.5 µL) was transferred into either 96-well or 384-well plates containing selective galactose medium (100 µL, replicate sets) and grown at 20° C. and 37° C. for 4 days. Yeast growth in galactose medium at both 20° C. and 30° C. was monitored at 48 hr, 72 hr and 96 hr and slow growing candidates in 20° C. were picked from corresponding glucose plates.

Yeast Growth Assay

Twelve constructs (from six inteins Hma_TopA, Hwa_RIR1-1, Kra_DnaB, Pho_IF2, Pho_r-Gyr and Unc-ERS_RIR1 in Savinase at both S135 and S317 sites) were previously tested in *E. coli* where three (intein Pho_IF2, Pho_r-Gyr and Unc-ERS_RIR1 at S317 site) showed splicing activity. When expressed in yeast, these three constructs inhibited yeast growth in selective galactose medium both on agar plates and in liquid culture while the other constructs did not, suggesting that spliced Savinase is toxic to yeast.

Yeast growth assay was used to evaluate natural inteins. Eight transformants from each of the 314 yeast expression constructs were grown in selective glucose medium (100 µL, 96-well plate, at 30° C. for 48 hrs) to saturation from which 2.5 µL aliquot was inoculated into 100 µL selective galactose medium in replicate 96-well plates, with one set grown at 30° C. for up to 72 hrs and another set 20° C. for up to 96 hrs during which OD590 nm measurement was taken daily for all samples.

Mutagenized intein variants were similarly evaluated. Transformants on the galactose library plates were hand-picked or picked by colony picker and grown in selective glucose medium (100 µL, 30° C. for 48 hrs). 2.5 µL aliquot was inoculated into 100 µL selective galactose medium in replicate 96-well plates, with one set grown at 30° C. and another set at 37° C. for up to 96 hrs. Colonies were selected as primary candidates that showed slow or no growth at 20° C. while normal growth at 30° C. Slow growth phenotype was validated by repeating growth test in galactose medium.

Yeast Cell Lysate-Based Savinase Activity Assay

Eight colonies from each of the 314 NICs were grown in non-selective glucose medium (200 µL, 96-well plate, at 30° C. for 48 hrs) to saturation. After centrifugation (3300 RPM 5 min), 1 mL selective galactose medium was added to each pellet, resuspended and grown at 30° C. for 6 hrs to induce recombinant protein production. Cells were harvested (3,300 RPM for 5 min at 37° C.) and re-suspended in 30 µL lysis buffer (CeLlytic Y cell lysis agent from Sigma supplemented with 15 unit/mL Zymolyase, 37° C. for 1 hr).

200 µL BR buffer (pH9.0) was added to each sample and 40 µL lysate was heat treated at 20° C., or 30° C. for 2 hrs before adding Succinyl-FAAF-pNA substrate and incubating at 37° C. for 1 hr. After clarification by centrifugation (4500 rpm, 5 min), supernatant was used for OD400 nm measurement.

In Vitro Synthesized Protein-Based Savinase Activity Assay

Top performing candidates from total cell lysate assay were PCR amplified and used to synthesize NIC proteins by one-tube transcription and translation (PURExpress, NEB). Synthesized NIC proteins were heat treated at 20° C. and 37° C. for 2 hrs before adding pNA substrate and incubating at 37° C. for 30 min. Time course of Savinase activity was followed by $OD_{400nm}$ measurement.

Concentration-dependent suppression of intein splicing by detergent was observed. Synthesized NICs, unmodified proSavinase and inactivated Savinase (H62A) were each mixed with detergents to final detergent concentrations of 25%, 5%, 1% and 0.2% and kept at 20° C. or 37° C. for 2 hrs to induce splicing. Kinetics of Savinase activity was then measured with Succinyl-FAAF-pNA substrate (37° C. 1.5 hr).

| Step | | A | B | dH$_2$O | DNA |
|---|---|---|---|---|---|
| 1 | Synthesize protein | | | | |
| | Volume Total 40 μL | 16 μL | 12 μL | 10 μL | 2 μL |
| | Temperature | 30° C. | | | |
| 2 | Add Detergent | 30° C. | | | |
| | Protein | 40 μL | | | |
| | CCH Buffer | 200 μL | | | |
| | Aliquote to 4 tubes | 60 μL | 60 μL | 60 μL | 60 μL |
| | Detergent | 20 μL of 100% | 20 μL of 20% | 20 μL of 4% | 20 μL of 0.8% |
| | Total Volume | 80 μL | 80 μL | 80 μL | 80 μL |
| | Final Detergent | 25% | 5% | 1% | 0.2% |
| 3 | Induce Splicing | Set 1 | Set 2 | | |
| | Temperature | 20° C. | 37° C. | | |
| | Volume | 40 μL | 40 μL | | |
| | Incubation time | 2 h | 2 h | | |
| 4 | Develop Color | Set 1 | Set 2 | | |
| | Temperature | 37° C. | 37° C. | | |
| | 2 x Substrate | 40 μL | 40 μL | | |
| | OD400 reading | 0-90 min | 0-90 min | | |

Intein-Splicing Upon Dilution of Detergent

Similar to the detergent suppression assay described above, Savinase from various constructs was synthesized, mixed with detergent to a final concentration of 25% detergent, and then diluted 10× with either H$_2$O or BR buffer (pH 9.0) to a final concentration of 2.5% detergent. Replicates were kept at 20° C. or 37° C. for 2 hrs to induce splicing before incubation with Succinyl-FAAF-pNA substrate at 37° C. for 90 min. OD 400 was measured with 1.0 min interval.

Sequences:

See the sequences in the sequence listing filed herewith, which incorporated herein by reference as if fully set forth.

REFERENCES

Baker D., Sohl J, and Agard D. (1992) A protein-folding reaction under kinetic control. Nature 356:263-265.

Bedford M. R. and Partridge G. G. edt. (2010) Enzymes in farm animal nutrition. 2$^{nd}$ edition. CAB International. Wallingford, Cambridge.

Bonifait L., de la Cruz Dominguez-Punaro M., Vaillancourt K., Bart C., Slater J., Frenette M., Gottschalk M. and Grenier D. (2010) The cell envelope subtilisin-like proteinase is a virulence determinant for Streptococcus suis. BMC Microbiology 2010, 10:42.

Brandelli A. (2008) Bacterial keratinases: Useful enzymes for bioprocessing agroindustrial wastes and beyond. Food Bioprocess Technol. 8, 35-42.

Brandelli A., Daroit D. J.; Riffel A. (2010) Biochemical features of microbial keratinases and their production and application. Appl. Microbiol. Biotechnol. 85, 1735-1750.

Bressollier P., Letourneau F., Urdaci M. and Verneuil B. (1999) Purification and Characterization of a Keratinolytic Serine Proteinase from Streptomyces albidoflavus. Applied and Environmental Microbiology 65(6) 2570-2576.

Carter P. and Wells J. A. (1988) Dissecting the catalytic triad of a serine protease. Nature 332:564-568.

Chin H. G. Kim G-D. Marin I., Mersha F., Evans T. C., Chen L., Xu M-Q. and Pradhan S. (2003) Protein trans-splicing in transgenic plant chloroplast: Reconstruction of herbicide resistance from split genes. Proc. Natl. Acad. Sci. USA, (2003) 100, 4510-4515.

Cowieson A. J. and Adeola O. (2005) Carbohydrases, protease, and phytase have an additive beneficial effect in nutritional marginal diets for broiler chicks. Poultry Science 84, 1860-1867.

Cowieson A. J., Hruby M. and Faurschou Isaksen, M. (2005) The effect of conditioning temperature and exogenous xylanase addition on the viscosity of wheat-based diets and the performance of broiler chickens. British Poultry Science 46: 717-724.

Davis B. G., Shang X., DeSantis G., Bott R. R., Jones J. B (1999) The controlled introduction of multiple negative charge at single amino acid sites in subtilisin Bacillus lentus. Bioorg Med Chem 1999, 7:2293-2301.

Fang N., Zhong C. Q., Liang X., Tang X. F., Tang B. (2010) Improvement of extracellular production of a thermophilic subtilase expressed in Escherichia coli by random mutagenesis of its N-terminal propeptide. Appl Microbiol Biotechnol. 85(5):1473-81.

Faye L., Boulaflous A., Benchabane M., Gomord V., and Michaud D. (2005) Protein modifications in the plant secretory pathway: current status and practical implications in molecular pharming. Vaccine, 23, 1770-1778.

Guoqiang C., Xiaohiu Z., Lei Z., Zhaoxin L. (2011) A modified electro-transformation method for Bacillus subtilis and its application in the production of antimicrobial lipopeptides. Biotechnology Letters, 33 (5), 1047-1051.

Gupta R., Ramnani P. (2006) Microbial keratinases and their prospective applications: An overview. Appl. Microbiol. Biotechnol. 70 (1), 21-33.

Hood E. E. and Woodard S. L. (2005) Commercialization of a protein product from transgenic maize. Natl. Agric. Biotech. Council 17, 147-157.

Ishida Y., Saito H., Ohta S., Hiei Y., Komari T. and Kumashiro T. (1996) High efficiency transformation of maize (Zea mays L.) mediated by Agrobacterium tumefaciens. Nature Biotech, 14(6), 745-750.

Ishida Y., Hiei Y. and Komari T. (2007) Agrobacterium-mediated transformation of maize. Nature Protocols, 2(7), 1614-1621.

Iwai H., Ziiger S., Jin J. and Tam P. H. (2006) Highly efficient protein trans-splicing by a naturally split DnaE intein from Nostoc punctiforme. FEBS Lett. 580(7), 1853-1858.

Jiang Z., Zhou Y., Lu F., Han Z. and Wang, T. (2008) Effects of different levels of supplementary alpha-amylase on digestive enzyme activities and pancreatic amylase mRNA expression of young broilers. Asian-Austrialian Journal of Animal Science 21, 97-102.

Kempe K., Rubtsova M. and Gils M. (2009) Intein-mediated protein assembly in transgenic wheat: production of active barnase and acetolactate synthase from split genes. Plant Biotechnology Journal, 7 (3), 283-297.

Komari T., Takakura Y., Ueki J, Kato N., Ishida Y. and Hiei Y. (2006) Methods in Molecular Biology, volume 343, Agrobacterium Protocols, volume 1, Binary Vectors and Super-binary Vectors, pages 15-41. Humana Press Inc., 2 edition.

Legendre D., Laraki N., Graslund T., Bjùrnvad M. E., Bouchet M., Nygren P-A., Borchert T. V. and Fastrez J. (2000) Display of Active Subtilisin 309 on Phage: Analysis of Parameters Influencing the Selection of Subtilisin Variants with Changed Substrate Specificity from Libraries using Phosphonylating Inhibitors. J. Mol. Biol. (2000) 296, 87-102.

Li, W.; Zhou, X.; Lu, P. Bottlenecks in the expression and secretion of heterologous proteins in Bacillus subtilis. Res. Microbiol. 2004, 155 (8), 605-610.

Lin X., Lee C-G., Casale E. S. and Shih J. C. H. (1992) Purification and Characterization of a Keratinase from a Feather-Degrading *Bacillus licheniformis* Strain. Applied and Environmental microbiology, 58 (10), 3271-3275.

Lin X., Wong S. L., Miller E. S., Shih J. C. H. (1997) Expression of the *Bacillus licheniformis* PWD-1 keratinase gene in *B. subtilis*. J. Ind. Microbiol. Biotechnol. 1997, 19 (2), 134-138.

Liu N., Ru Y. J., Cowieson A. J., Li F. D. and Cheng X. C. H. (2008a) Effects of phytate and phytase on the performance and immune function of broilers fed nutritionally marginal diets. Poultry Science 87, 1105-1111.

Liu N., Ru Y. J., Li F. D. and Cowieson A. J. (2008b) Effect of diet containing phytate and phytase on the activity and mRNA expression of carbohydrase and transporter in chickens. Journal of Animal Science published online on Aug. 15, 2008 as doi: 10.2527/jas.2008-1234.

Lu Y. P., Zhang C., Lv F. X., Bie X. M., Lu Z. X. (2012) Study on the electro-transformation conditions of improving transformation efficiency for *Bacillus subtilis*. Lett Appl Microbiol, 55(1):9-14.

Mathlouthi N., Saulnier L., Quemener B. and Larbier M. (2002) Xylanase, β-glucanase, and other side enzymatic activities have greater effects on viscosity of several feedstuffs than xylanase or β-glucanase used alone or in combination. Journal of Agricultural and Food Chemistry 50: 5121-5127.

Odetallah N. H., Parks C. W. and Ferket P. R. (2002a) Effect of natugrain enzyme preparation on the performance characteristics of tom turkeys fed wheat-based rations. Poult. Sci. 81, 987-994.

Odetallah N. H., Ferket P. R, Grimes, J. L. and McNaughton J. L. (2002b) Effect of mannan-endo-1,4-β-mannosidase on the growth performance of turkeys fed diets containing 44% CP and 48% CP soybean meal. Poult. Sci. 81, 1322-1331.

Odetallah N. H., Wang J. J., Garlich J. D and Shih J. C. H. (2003) Keratinase in Starter Diets Improves Growth of Broiler Chicks. Poultry Science 82, 664-670.

Ohta Y. Hojo H., Aimoto S. Kobayashi T., Zhu X., Jordan F and Inouye M. (1991) Pro-peptide as an intermolecular chaperone: renaturation of denatured subtilisin E with a synthetic pro-peptide. Mol Microbiol. 5, 1507-1510

Otomo T., Ito N., Kyogoku Y. and Yamazaki T. (1999) NMR observation of selected segments in a larger protein: central-segment isotope labeling through intein-mediated ligation. Biochemistry 38, 16040-16044.

Phrommao E., Yongsawatdigul J., Rodtong S. and Yamabhai M. (2011) A novel subtilase with NaCl-activated and oxidant-stable activity from Virgibacillus sp. SK37. BMC Biotechnology 2011, 11:65-79.

Pierce J. A., Robertson C. R. and Leighton T. J. (1992) Physiological and genetic strategies for enhanced subtilisin production by *Bacillus subtilis*. Biotechnol. Prog. 8: 211-218.

Porres, J. M., Benito, M. J., & Lei, X. G. (2002). Functional expression of keratinase (kerA) gene from *Bacillus licheniformis* in *Pichia pastoris*. Biotechnology Letters, 24, 631-636.

Privalle L. S. (2002) Phosphomannose isomerase, a novel plant selection system. Ann. N.Y. Acad. Sci. 964: 129-138.

Shinde U. and Inouye M. (1995) Folding pathway mediated by an intramolecular chaperone: characterization of the structural changes in pro-subtilisin E coincident with autoprocessing. J. Mol. Biol., 252, 25-30.

Short F. Hruby, M, Burrows H., and Bedford M. (2002) The effect of a xylanase and protease enzyme on egg production in laying birds fed wheat based diets. Poult. Sci. 81(Suppl. 1):136. (Abstr.) Uni, Z., Y. Noy.

Siezen R. J. and Leunissen J. A. (1997) Subtiliases: the superfamily of subtilisin-like serine proteases. Protein Science 6, 501-523.

Simbaya J., Slominski B. A., Guenter W., Morgan A. and Campbell L. D. (1996) The effects of protease and carbohydrase supplementation on the nutritive value of canola meal for poultry: In vitro and in vivo studies. Animal feed Sci and Tech. 61, 219-234.

Sokol P. A., Ohman D. E. and Iglewski B. H. (1979) More sensitive plate assay for detection of protease production by *Pseudomonas aeruginosa*. J. Clinical Microbiology 9(4), 538-540.

Stark, C. R., Spencer, B. E., Shih, J. C. H., Chewning, C. G. and Wang J. J. (2009) Evaluation of keratinase stability in pelleted broiler diets. J. Appl. Poult. Res. 18:30-33.

Takagi H. and Takahashi (2003) A new approach for alteration of protease functions: pro-sequence engineering. Appl. Microbiol. Biotechnol. 63, 1-9.

Tiwary E. and Gupta R. (2010) Extracellular Expression of Keratinase from *Bacillus licheniformis* ER-15 in *Escherichia coli*. J. Agric. Food Chem., 58 (14), 8380-8385.

Vazqueza S. C., Coriab S. H. and Cormackb W. P. M. (2004) Extracellular proteases from eight psychrotolerant antarctic strains Microbiological Research 159:157-166.

Wang J. J., and Shih J. C. H. (1999) Fermentation production of keratinase from *Bacillus licheniformis* PWD-1 and a recombinant *B. subtilis* FDB-29. J. Industrial Microbiology and Biotechnology, 22, 608-616.

Wang J. J., Swaisgood H. E. and Shih, J. C. H. (2003). Bioimmobilization of keratinase using *Bacillus subtilis* and *Escherichia coli* systems. Biotechnology and Bioengineering, 81, 421-429.

Wang, J. J.; Rojanatavorn, K.; Shih, J. C. H. Increased production of *Bacillus* keratinase by chromosomal integration of multiple copies of the kerA gene. Biotechnol. Bioeng. 2004, 87 (4), 459-464.

Wang J. J., Garlich J. D. and Shih, J. C. H. (2006a) Beneficial Effects of Versazyme, a Keratinase Feed Additive, on Body Weight, Feed Conversion, and Breast Yield of Broiler Chickens. J. Appl. Poult. Res. 15, 544-550.

Woodard S. L., Mayor J. M., Bailey M. R., Barker D. K., Love R. T., Lane J. R., Delaney D. E., McComas-Wagner J. M., Mallubhotla H. D., Hood E. E., Dangott L. J., Tichy S. E., Howard J. A. (2003) Maize (*Zea mays*)-derived bovine trypsin: characterization of the first large-scale, commercial protein product from transgenic plants. Biotechnol Appl Biochem. 2003 October; 38(Pt 2), 123-30.

Yabuta Y., Takagi H., Inouye M. and Shinde U (2001) Folding pathway mediated by an intramolecular chaperone. Propeptide-release modulates precise activation of a protease. J Biol Chem. 276, 44427-44434.

Yamabhai M., Emrat S., Sukasem S., Pesatcha P., Jaruseranee N. and Buranabanyat B (2008) Secretion of recombinant *Bacillus* hydrolytic enzymes using *Escherichia coli* expression systems. J Biotechnol. 133(1):50-57.

Yamazaki T., Otomo T., Oda N., Kyogoku Y., Uegaki K, Ishino Y., Nakamura H (1998) Segmental isotope labeling for protein NMR using peptide splicing. J. Amer. Chem. Soc. 120, 5591-5592.

Yang J., Fox G. C. and Henry-Smith T. V. (2003) Intein-mediated assembly of a functional β-glucuronidase in transgenic plants. Proc. Natl. Acad. Sci. USA 100, 3513-3518.

Yeh C. M., Wang J. P. and Su F. S. (2007) Extracellular production of a novel ice structuring protein by *Bacillus subtilis*; A case of recombinant food peptide additive production. Food Biotechnol. 21 (1-2), 119-128.

You L. and Arnold F. H. (1994) Directed evolution of subtilisin E in *B. subtilis* to enhance total activity in aqueous dimethylformamide. Protein Eng 1994, 9:77-83.

Zhao M. L., Mo M. H., Zhang K. Q. (2004) Characterization of a neutral serine protease and its full-length cDNA from the nematode-trapping fungus *Arthrobotrys oligospora*. Mycologia 96, 16-22.

The references cited throughout this application are incorporated for all purposes apparent herein and in the references themselves as if each reference was fully set forth. For the sake of presentation, specific ones of these references are cited at particular locations herein. A citation of a reference at a particular location indicates a manner(s) in which the teachings of the reference are incorporated. However, a citation of a reference at a particular location does not limit the manner in which all of the teachings of the cited reference are incorporated for all purposes.

It is understood, therefore, that this invention is not limited to the particular embodiments disclosed, but is intended to cover all modifications which are within the spirit and scope of the invention as defined by the appended claims; the above description; and/or shown in the attached drawings.

SEQUENCE LISTING (718 sequences)

SEQ ID NO: 1 - protein, 380 aa, Bacillus lentus
  MISC_FEATURE (1)..(380): P29600
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 2 - protein, 269 aa, Bacillus lentus
  MISC_FEATURE (1)..(269): P29599
AQSVPWGISRVQAPAAHNRGLTGSGVKVAVLDTGISTHPDLNIRGGASFVPGEPSTQDGNGHGTHVAGTIAALNNSIGVLGVAPSAELYAVKVLGADGRGAISSIAQGLEWAGNNGMHVANLSLGSPSPSATLEQAVNSATSRGVLVVAASGNSGASSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 3 - protein, 275 aa, Bacillus pumilus
  MISC_FEATURE (1)..(275): P07518
AQSVPYGISQIKAPALHSQGYTGSNVKVAVIDSGIDSSHPDLNVRGGASFVPSETNPYQDGSSHGTHVAGTIAALNNSIGVLGVAPSSALYAVKVLDSTGSGQYSWIINGIEWAISNNMDVINMSLGGPTGSTALKTVVDKAVSSGIVVAAAAGNEGSSGSTSTVGYPAKYPSTIAVGAVNSANQRASFSSAGSELDVMAPGVSIQSTLPGGTYGAYNGTSMATPHVAGAAALILSKHPTWTNAQVRDRLESTATYLGSSFYYGKGLINVQAAAQ

SEQ ID NO: 4 - protein, 381 aa, Bacillus subtilis
  MISC_FEATURE (1)..(381): P04189
MRSKKLWISLLFALTLIFTMAFSNMSAQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVAPSASLYAVKVLDSTGSGQYSWIINGIEWAISNNMDVINMSLGGPTGSTALKTVVDKAVSSGIVVAAAAGNEGSSGSTSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 5 - protein, 274 aa, Bacillus licheniformis
  MISC_FEATURE (1)..(274): P00781
AQTVPYGIPLIKADKVQAQGYKGANVKVGIIDTGIAASHTDLKVVGGASFVSGESYNTDGNGHGTHVAGTVAALDNTTGVLGVAPNVSLYAIKVLNSSGSGTYSAIVSGIEWATQNGLDVINMSLGGPSGSTALKQAVDKAYASGIVVVAAAGNSGSSGSQNTIGYPAKYDSVIAVGAVDSNKNRASFSSVGAELEVMAPGVSVYSTYPSNTYTSLNGTSMASPHVAGAAALILSKYPTLSASQVRNRLSSTATNLGDSFYYGKGLINVEAAAQ

SEQ ID NO: 6 - protein, 382 aa, Bacillus amyloliquefaciens
  MISC_FEATURE (1)..(382): P00782
MRGKKVWISLLFALALIFTMAFGSTSSAQAAGKSNGEKKYIVGFKQTMSTMSAAKKKDVISEKGGKVQKQFKYVDAASATLNEKAVKELKKDPSVAYVEEDHVAHAYAQSVPYGVSQIKAPALHSQGYTGSNVKVAVIDSGIDSSHPDLKVAGGASMVPSETNPFQDNNSHGTHVAGTVAALNNSIGVLGVAPSASLYAVKVLGADGSGQYSWIINGIEWAIANNMDVINMSLGGPSGSAALKAAVDKAVASGVVVVAAAGNEGTSGSSSTVGYPGKYPSVIAVGAVDSSNQRASFSSVGPELDVMAPGVSIQSTLPGNKYGAYNGTSMASPHVAGAAALILSKHPNWTNTQVRSSLENTTTKLGDSFYYGKGLINVQAAAQ

SEQ ID NO: 7 - protein, 420 aa, Bacillus sp. TA39
  MISC_FEATURE (1)..(420): P28842
MKRSGKIFTTAMLAVTLMMPAMGVSANEGNAAAEGNEKFRVLVDSVDQKNLKNAKQQYGVHWDFAGEGFTTDMNEKQFNALKKNKNLTVEKVPELEIATATDKPEALYNAMAASQSTPWGIKAIYNNSSITQTSGGGGINIAVLDTGVNTNHPDLRNNVEQCKDFTVGTTYTNNSCTDRQGHGTHVAGSALADGGTGNGVYGVAPDADLWAYKVLGDDGSGYADDIAAAIRHAGDQATALNTKVVINMSLGSSGESSLITNAVNYSYNKGVLIIAAAGNSGPYQGSIGYPGALVNAVAVAALENKVENGTYRVADFSSRGYSWTDGDYAIQKGDVEISAPGAAIYSTWFDGGYATISGTSMASPHAAGLAAKIWAQYPSASNVDVRGELQYRAYENDILSGYYAGYGDDFASGFGFATVQ

SEQ ID NO: 8 - protein, 381 aa, Bacillus stearothermophilus
  MISC_FEATURE (1)..(381): P29142
MRSKKLWISLLFALTLIFTMAFSNMSVQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVSPSASLYAVKVLDSTGSGQYSWIINGIEWAISNNMDVINMSLGGPSGSTALKTVVDKAVSSGIVVAAAAGNEGSSGSSSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 9 - protein, 381 aa, Bacillus subtilis
  MISC_FEATURE (1)..(381): P35835
MRSKKLWISLLFALTLIFTMAFSNMSAQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVAPSASLYAVKVLDSTGSGQYSWIINGIEWAISNNMDVINMSLGGPTGSTALKTVVDKAVSSGIVVAAAAGNEGSSGSTSTVGYPAKYPSTIAVGAVNSSNQRASFSSVGSELDVMAPGVSIQSTLPGGTYGAYNGTSMATPHVAGAAALILSKHPTWTNAQVRDRLESTATYLGNSFYYGKGLINVQAAAQ

SEQ ID NO: 10 - protein, 379 aa, Bacillus licheniformis
  MISC_FEATURE (1)..(379): P00780
MMRKKSFWLGMLTAFMLVFTMAFSDSASAAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGTYSGIVSGIEWATTNGMDVINMSLGGPSGSTAMKQAVDNAYARGVVVVAAAGNSGSSGNTNTIGYPAKYDSVIAVGAVDSNSNRASFSSVGAELEVMAPGAGVYSTYPTSTYATLNGTSMASPHVAGAAALILSKHPNLSASQVRNRLSSTATYLGSSFYYGKGLINVEAAAQ

SEQ ID NO: 11 - protein, 381 aa, Bacillus amylosacchariticus
  MISC_FEATURE (1)..(269): P00783
MRSKKLWISLLFALTLIFTMAFSNMSAQAAGKSSTEKKYIVGFKQTMSAMSSAKKKDVISEKGGKVQKQFKYVNAAAATLDEKAVKELKKDPSVAYVEEDHIAHEYAQSVPYGISQIKAPALHSQGYTGSNVKVAVIDSGIDSSHPDLNVRGGASFVPSETNPYQDGSSHGTHVAGTIAALNNSIGVLGVSPSASLYAVKVLDSTGSGQYSWIINGIEWAISNNMDVINMSLGGPSGSTALKTVVDKAVSSGIVVAAAAGNEGSSGSSSTVGYPAKYPSTIAVGAVNSSNQRASFSSAGSELDVMAPGVSIQSTLPGGTYGAYNGTSMATPHVAGAAALILSKHPTWTNAQVRDRLESTATYLGNSFYYGKGLINVQAAAQ

SEQ ID NO: 12 - protein, 379 aa, Bacillus licheniformis
  MISC_FEATURE (1)..(379): Q53521
MMRKKSFWLGMLTAFMLVFTMAFSDSASAAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMVSPHVAGAAALILSKHPNLSASQVRNRLSSTATYLGSSFYYGKGLINVEAAAQ

SEQ ID NO: 13 - protein, 202 aa, Artificial Sequence
  Synthetic Construct NI-1
MAQPAKNVEKDYIVGFKSGVKTASVKKDIIKESGGKVDKQFRIINAAKAKLDKEALKEVKNDPDVAYVEEDHVAHALAQCLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 14 - protein, 309 aa, Artificial Sequence
  Synthetic Construct IC-1
MVKVIGRRSLGVQRIFDIGLPQDHNFLLANGAIAANCTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMVSPHVAGAAALILSKHPNLSASQVRNRLSSTATYLGSSFYYGKGLINVEAAAQ

SEQ ID NO: 15 - protein, 248 aa, Artificial Sequence
  Synthetic Construct NI-2
MAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGACLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 16 - protein, 263 aa, Artificial Sequence
  Synthetic Construct IC-2
MVKVIGRRSLGVQRIFDIGLPQDHNFLLANGAIAANCSFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNTYATLNGTSMVSPHVAGAAALILSKHPNLSASQVRNRLSSTATYLGSSFYYGKGLINVEAAAQ

SEQ ID NO: 17 - protein, 328 aa, Artificial Sequence
  Synthetic Construct NI-3
MAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGACLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 18 - protein, 183 aa, Artificial Sequence
  Synthetic Construct IC-3
MVKVIGRRSLGVQRIFDIGLPQDHNFLLANGAIAANCSGSTAMKQAVDNAYARGVVVVAAAGNSGSSGNTNTIGYPAKYDSVIAVGAVDSNSNRASFSSVGAELEVMAPGAGVYSTYPTNTYATLNGTSMVSPHVAGAAALILSKHPNLSASQVRNRLSSTATYLGSSFYYGKGLINVEAAAQ

SEQ ID NO: 19 - protein, 354 aa, Artificial Sequence
  Synthetic Construct NI-4
MAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNCLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 20 - protein, 157 aa, Artificial Sequence
  Synthetic Construct IC-4
MVKVIGRRSLGVQRIFDIGLPQDHNFLLANGAIAANCSGSSGNTNTIGYPAKYDSVIAVGAVDSNSNRASFSSVGAELEVMAPGAGVYSTYPTNTYATLNGTSMVSPHVAGAAALILSKHPNLSASQVRNRLSSTATYLGSSFYYGKGLINVEAAAQ

SEQ ID NO: 21 - protein, 357 aa, Artificial Sequence
  Synthetic Construct NI-5
MAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSCLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 22 - protein, 154 aa, Artificial Sequence
  Synthetic Construct IC-5
MVKVIGRRSLGVQRIFDIGLPQDHNFLLANGAIAANCSGNTNTIGYPAKYDSVIAVGAVDSNSNRASFSSVGAELEVMAPGAGVYSTYPTNTYATLNGTSMVSPHVAGAAALILSKHPNLSASQVRNRLSSTATYLGSSFYYGKGLINVEAAAQ

SEQ ID NO: 23 - protein, 411 aa, Artificial Sequence
  Synthetic Construct NI-6
MAQPAKNVEKDYIVGFKSGVKTASVKKDIIKESGGKVDKQFRIINAAKAKLDKEALKEVKNDPDVAYVEEDHVAHALAQTVPYGIPLIKADKVQAQGFKGANVKVAVLDTGIQASHPDLNVVGGASFVAGEAYNTDGNGHGTHVAGTVAALDNTTGVLGVAPSVSLYAVKVLNSSGSGSYSGIVSGIEWATTNGMDVINMSLGGASGSTAMKQAVDNAYARGVVVVAAAGNSGSSGNTNTIGYPAKYDSVIAVGAVDSNSNRASFSSVGAELEVMAPGAGVYSTYPTNCLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 24 - protein, 100 aa, Artificial Sequence
  Synthetic Construct IC-6
MVKVIGRRSLGVQRIFDIGLPQDHNFLLANGAIAANCTYATLNGTSMVSPHVAGAAALILSKHPNLSASQVRNRLSSTATYLGSSFYYGKGLINVEAAAQ

SEQ ID NO: 25 - protein, 834 aa, Artificial Sequence
  Synthetic Construct VMA1
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 26 - protein, 834 aa, Artificial Sequence
  Synthetic Construct VMA2
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 27 - protein, 834 aa, Artificial Sequence
  Synthetic Construct VMA3
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 28 - protein, 834 aa, Artificial Sequence
  Synthetic Construct VMA4
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 29 - protein, 834 aa, Artificial Sequence
  Synthetic Construct VMA5
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 30 - protein, 834 aa, Artificial Sequence
  Synthetic Construct VMA6
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNSNVQIRNHLKNTATSLGSTNLYGSGLVNAEAATR

SEQ ID NO: 31 - protein, 803 aa, Artificial Sequence
  Synthetic Construct Tth1
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 32 - protein, 803 aa, Artificial Sequence
  Synthetic Construct Tth2
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 33 - protein, 803 aa, Artificial Sequence
  Synthetic Construct Tth3
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 34 - protein, 803 aa, Artificial Sequence
  Synthetic Construct Tth4
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 35 - protein, 803 aa, Artificial Sequence
  Synthetic Construct Tth5
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 36 - protein, 803 aa, Artificial Sequence
  Synthetic Construct Tth6
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWCLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSNVQIRNHLKNTATSLGSTNLYGSGLVNAEAATR

SEQ ID NO: 37 - protein, 454 aa, Saccharomyces cerevisiae
  misc_feature (1)..(454): VMA
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHN

SEQ ID NO: 38 - protein, 123 aa, Synechocystis PCC6803
  misc_feature (1)..(123): DnaE-N
CLSFGTEILTVEYGPLPIGKIVSEEINCSVYSVDPEGRVYTQAIAQWHDRGEQEVLEYELEDGSVIRATSDHRFLTTDYQLLAIEEIFARQLDLLTLENIKQTEEALDNHRLPFPLLDAGTIK

SEQ ID NO: 39 - protein, 36 aa, Synechocystis PCC6803
  misc_feature (1)..(36): DnaE-C
MVKVIGRRSLGVQRIFDIGLPQDHNFLLANGAIAAN

SEQ ID NO: 40 - protein, 423 aa, Thermus thermophilus
  misc_feature (1)..(423): Tth
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKDPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHN

SEQ ID NO: 41 - DNA, 1140 bp, Artificial sequence
  Synthetic Construct Q53521 codon optimized
atgatgaggaagaagtccttctggcttggcatgctgacagccttcatgctggtgttcacgatggctttctccgacagcgcttctgctgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatga

SEQ ID NO: 42 - DNA, 369 bp, Artificial sequence
  Synthetic Construct DnaE-N codon optimized
tgcctttctttcggaactgagatccttaccgttgagtacggaccacttcctattggtaagatcgtttctgaggaaattaactgctcagtgtactctgttgatccagaaggaagagtttacactcaggctatcgcacaatggcacgataggggtgaacaagaggttctggagtacgagcttgaagatggatccgttattcgtgctacctctgaccatagattcttgactacagattatcagcttctcgctatcgaggaaatctttgctaggcaacttgatctccttactttggagaacatcaagcagacagaagaggctcttgacaaccacagacttccattccctttgctcgatgctggaaccatcaag

SEQ ID NO: 43 - DNA, 108 bp, Artificial sequence
  Synthetic Construct DnaE-C codon optimized
atggttaaggtgattggaagacgttctcttggtgttcaaaggatcttcgatatcggattgccacaagaccacaactttcttctcgctaatggtgccatcgctgccaat

SEQ ID NO: 44 - DNA, 2881 bp, Artificial Sequence
  Synthetic construct pAG2209
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctatggccaccatcgctttctcccgcttgtccatctacttctgcgtgcttctcctgtgccacggctccatggccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 45 - DNA, 2899 bp, Artificial Sequence
  Synthetic construct pAG2210
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctatggccaccatcgctttctcccgcttgtccatctacttctgcgtgcttctcctgtgccacggctccatggccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 46 - DNA, 2887 bp, Artificial Sequence
  Synthetic construct pAG2211
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctatggccaccatcgctttctcccgcttgtccatctacttctgcgtgcttctcctgtgccacggctccatggcccagctggctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 47 - DNA, 2905 bp, Artificial Sequence
  Synthetic construct pAG2212
tacagggttccttgcgtgaagaagggtggcctgcggttcaccattaacggtcacgactacttccagctagtactggtgaccaacgtcgcggcggcagggtcaatcaagtccatggaggttatgggttccaacacagcggattggatgccgatggcacgtaactggggcgcccaatggcactcactggcctacctcaccggtcaaggtctatcctttagggtcaccaacacagatgaccaaacgctcgtcttcaccaacgtcgtgccaccaggatggaagtttggccagacatttgcaagcaagctgcagttcaagtgagaggagaagcctgaattgataccggagcgtttcttttgggagtaacatctctggttgcctagcaaacatatgattgtatataagtttcgttgtgcgtttattctttcggtgtgtaaaataacatacatgctttcctgatattttcttgtatatatgtacacacacacgacaaatccttccatttctattattattgaacaatttaattgcgagggcgagtacttgtctgtttaccttttttttttcagatggcattttatagtttaacctttcatggaccggcagtagttctaaccatgaatgaaaagaaatcatagtccacaccacgcagggacattgtggtcattttagacaagacgatttgattaatgtcttgtatgatatggtcgacagtgaggactaacaaacatatggcatattttattaccggcgagttaaataaatttatgtcacagtaataaactgcctaataaatgcacgccagaaaatataatgataaaaaaaagaaaagatacataagtccattgcttctacttttttaaaaattaaatccaacattttctattttttggtataaacttggaagtactagttggatatgcaaaatcatctaacctccatatatttcatcaatttgtttactttacatatgggagaggatagtatgtcaaagaaaatgacaacaagcttacaagtttcttattttaaaagttccgctaacttatcaagcatagtgtgccacgcaaaactgacaacaaaccaacaaatttaaggagcgcctaacttatcatctatgacataccgcacaaaatgataacatactagagaaactttattgcacaaaaggaaatttatccataaggcaaaggaacatcttaaggctttggatatacatttaccaacaagcattgtttgtattacccctaaagcgcaagacatgtcatccatgagtcatagtgtgtatatctcaacattgcaaagctaccttttttctattatacttttcgcattataggctagatattatctatacatgtcaacaaactctatccctacgtcatatctgaagattcttttcttcactatataagttggcttccctgtcattgaactcacatcaaccagcccaagtttccaataacatcctcaaatagctatggccaccatcgctttctcccgcttgtccatctacttctgcgtgcttctcctgtgccacggctccatggcccagctggctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 48 - DNA, 3802 bp, Artificial Sequence
  Synthetic construct pAG2216
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacacctgttgaccattggggtatgcttgctctcctgttcatctccgtgctaaacctctgtcctctgggtgggtttttgctgggattttgagctaatctgctggccgcggtagaaaagaccgtgtcccctgatgagctcaagcgctcgccttagccgcgtccttgtcccccgccatttcttgcggtttcgctgtgttcccgtgactcgccgggtgcgtcatcgcctgaatcttgtctgggctctgctgacatgttcttggctagttgggtttatagattcctctgatctaaaaccgtgcctgtgctgcgcacagaactctcccctgtcctttcctggggttttggttacgtggtggtagtaagcttggatttgcacatggataaagttgttctaagctccgtggtttgcttgagatcttgctgttattgcgtgccgtgctcacttcttttgcaatccgaggaatgaatttgtcgtttactcgttttggtggattattagcgcgaaaaaaaactctttttttttgttcttttactacgaaaagcatcttcttggattttgctatcttcttttactacgaaaaactcttgagtctaggaatttgaatttgtgatgtccattcttgcagtgcgctgtgctttattgggaagccaaatcctattattttctgcctctagggtctgaatggaatcagtactcttgagacaaaatcaatccaatcaagttgatttctttctttaaaaatattatcacagaactaagtgcttgtgcggaatcagtactggcttttgtttggtggaggatcaatacttgcttttgttttggggtggcaactgttttgctataagattccatgtgttcctgttgagatgaatcatatatagtatagctgcatactacaaatctgtttttcaaatttaggttgctttggcatgatcaattttttttcagacagtctttctaagtggtagctcttgatttcttgttcttctacaactggtgctgctgaatcttgaccgtatagctcgaattgcagtattctgaaccatcgagccatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 49 - DNA, 3316 bp, Artificial Sequence
  Synthetic construct pAG2217
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacacctgatcaagtgcaaaggtccgccttgtttctcctctgtctcttgatctgactaatcttggtttatgattcgttgagtaattttggggaaagcttcgtccacagtttttttttcgatgaacagtgccgcagtggcgctgatcttgtatgctatcctgcaatcgtggtgaacttatgtcttttatatccttcactaccatgaaaagactagtaatctttctcgatgtaacatcgtccagcactgctattaccgtgtggtccatccgacagtctggctgaacacatcatacgatattgagcaaagatctatcttccctgttctttaatgaaagacgtcattttcatcagtatgatctaagaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggtggcatatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 50 - DNA, 3791 bp, Artificial Sequence
  Synthetic construct pAG2218
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctttgtgatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 51 - DNA, 3820 bp, Artificial Sequence
  Synthetic construct pAG2219
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacacctgttgaccattggggtatgcttgctctcctgttcatctccgtgctaaacctctgtcctctgggtgggtttttgctgggattttgagctaatctgctggccgcggtagaaaagaccgtgtcccctgatgagctcaagcgctcgccttagccgcgtccttgtcccccgccatttcttgcggtttcgctgtgttcccgtgactcgccgggtgcgtcatcgcctgaatcttgtctgggctctgctgacatgttcttggctagttgggtttatagattcctctgatctaaaaccgtgcctgtgctgcgcacagaactctcccctgtcctttcctggggttttggttacgtggtggtagtaagcttggatttgcacatggataaagttgttctaagctccgtggtttgcttgagatcttgctgttattgcgtgccgtgctcacttcttttgcaatccgaggaatgaatttgtcgtttactcgttttggtggattattagcgcgaaaaaaaactctttttttttgttcttttactacgaaaagcatcttcttggattttgctatcttcttttactacgaaaaactcttgagtctaggaatttgaatttgtgatgtccattcttgcagtgcgctgtgctttattgggaagccaaatcctattattttctgcctctagggtctgaatggaatcagtactcttgagacaaaatcaatccaatcaagttgatttctttctttaaaaatattatcacagaactaagtgcttgtgcggaatcagtactggcttttgtttggtggaggatcaatacttgcttttgttttggggtggcaactgttttgctataagattccatgtgttcctgttgagatgaatcatatatagtatagctgcatactacaaatctgtttttcaaatttaggttgctttggcatgatcaattttttttcagacagtctttctaagtggtagctcttgatttcttgttcttctacaactggtgctgctgaatcttgaccgtatagctcgaattgcagtattctgaaccatcgagccatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 52 - DNA, 3334 bp, Artificial Sequence
  Synthetic construct pAG2220
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacacctgatcaagtgcaaaggtccgccttgtttctcctctgtctcttgatctgactaatcttggtttatgattcgttgagtaattttggggaaagcttcgtccacagtttttttttcgatgaacagtgccgcagtggcgctgatcttgtatgctatcctgcaatcgtggtgaacttatgtcttttatatccttcactaccatgaaaagactagtaatctttctcgatgtaacatcgtccagcactgctattaccgtgtggtccatccgacagtctggctgaacacatcatacgatattgagcaaagatctatcttccctgttctttaatgaaagacgtcattttcatcagtatgatctaagaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggtggcatatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 53 - DNA, 3809 bp, Artificial Sequence
  Synthetic construct pAG2221
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctttgtgatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 54 - DNA, 2755 bp, Artificial Sequence
  Synthetic construct pAG2222
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 55 - DNA, 2773 bp, Artificial Sequence
  Synthetic construct pAG2223
aaagtaatcatattattttatgtgtgaatcttctttactttttcatttgattatgattatgaaggtatgaccttcataaccttcgtccgaaatccattatatccaaaggaaaataatgcttcgaaggacgaaggattttgatatttaacattttatgttgccttgttcttaattcatagcatttgagaacaagtccccaacaccaatctttatctttactatattaaagcaccagttcaacgatcgtctcgtgtcaatattattaaaaaactcctacatttctttataatcaacccgcactcttataatctcttctcttactactataataagagagtttatgtacaaaataaggtgaaattatgtataagtgttctggaccttggttgttggctcatattcacacaacctaatcaatagaaaacatatgttttattaaaacaaaatttatcatatatatatatatatatatatatatatatatatatatatataatataaaccgtagcaatgcacaggcatatgactagtggcaacttaataccatgtgtgtattaagatgaataagaggtatccaaataaataacttgttcgcttacgtctggatcgaaaggggttggaaacgattaaatctcttcctagtcaaaattaaatagaaggagatttaatcgatttctcccaatccccttcgatccaggtgcaaccgaataagtccttaaatgttgaggaacacgaaacaaccatgcattggcatgtaaagctccaagaattcgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgacaccatgagggtgttgctcgttgccctcgctctcctggctctcgctgcgagcgccacctccgctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 56 - DNA, 12310 bp, Artificial Sequence
  Synthetic construct pAG2005
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctctccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagcccgggtattcatcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 57 - protein, 354 aa, Bacillus lentus
  MISC_FEATURE (1)..(354): Pro-savinase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 58 - protein, 270 aa, Bacillus lentus
  MISC_FEATURE (1)..(270): Savinase catalytic domain
MAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 59 - DNA, 1143 bp, Bacillus lentus
  misc_feature (1)..(1143): P29600
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 60 - DNA, 1167 bp, Artificial Sequence
  Synthetic construct pHT01-preprosavinase-8His
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgtcaccatcaccatcatcaccaccattaa

SEQ ID NO: 61 - protein, 388 aa, Artificial Sequence
  Synthetic construct pHT01-pre-prosavinase-8His
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATRHHHHHHHH

SEQ ID NO: 62 - DNA, 1089 bp, Artificial Sequence
  Synthetic construct pHT01-prosavinase-8His
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgtcaccatcaccatcatcaccaccattaa

SEQ ID NO: 63 - protein, 362 aa, Artificial Sequence
  Synthetic construct pHT01-prosavinase-8His
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATRHHHHHHHH

SEQ ID NO: 64 - DNA, 837 bp, Artificial Sequence
  Synthetic construct pHT01-savinase-8His
atggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgtcaccatcaccatcatcaccaccattaa

SEQ ID NO: 65 - protein, 278 aa, Artificial Sequence
  Synthetic construct pHT01-savinase-8His
MAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATRHHHHHHHH

SEQ ID NO: 66 - DNA, 1167 bp, Artificial Sequence; identical to SEQ ID NO: 60
  Synthetic construct pHT43-preprosavinase-8His

SEQ ID NO: 67 - protein, 388 aa, Artificial Sequence; identical to SEQ ID NO: 61
  Synthetic construct pHT43-preprosavinase-8His

SEQ ID NO: 68 - DNA, 1188 bp, Artificial Sequence
  Synthetic construct pHT43-prosavinase-8His
atgattcaaaaacgaaagcggacagtttcgttcagacttgtgcttatgtgcacgctgttatttgtcagtttgccgattacaaaaacatcagccgtaggatccgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgtcaccatcaccatcatcaccaccattaa

SEQ ID NO: 69 - protein, 395 aa, Artificial Sequence
  Synthetic construct pHT43-prosavinase-8His
MIQKRKRTVSFRLVLMCTLLFVSLPITKTSAVGSAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATRHHHHHHHH

SEQ ID NO: 70 - DNA, 936 bp, Artificial Sequence
  Synthetic construct pHT43-savinase-8His
atgattcaaaaacgaaagcggacagtttcgttcagacttgtgcttatgtgcacgctgttatttgtcagtttgccgattacaaaaacatcagccgtaggatccgcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgtcaccatcaccatcatcaccaccattaa

SEQ ID NO: 71 - protein, 311 aa, Artificial Sequence
  Synthetic construct pHT43-savinase-8His
MIQKRKRTVSFRLVLMCTLLFVSLPITKTSAVGSAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATRHHHHHHHH

SEQ ID NO: 72 - DNA, 987 bp, Artificial Sequence
  Synthetic construct mTth:EU59 intein
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 73 - DNA, 2049 bp, Artificial Sequence
  Synthetic construct ProSavinase S46
caaaagaaaaatatttaattggctttaatgagcaggaagctgtctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 74 - DNA, 2049 bp, Artificial Sequence
  Synthetic construct ProSavinase S62
caaaagaaaaatatttaattggctttaatgagcaggaagctgtcagtgagtttgtagaacaagtagaggcaaatgacgaggtcgccattctctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 75 - DNA, 2049 bp, Artificial Sequence
  Synthetic construct ProSavinase T77
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 76 - DNA, 2049 bp, Artificial Sequence
  Synthetic construct ProSavinase S86
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 77 - DNA, 2049 bp, Artificial Sequence
  Synthetic construct ProSavinase S100
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 78 - DNA, 2049 bp, Artificial Sequence
  Synthetic construct ProSavinase T109
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 79 - DNA, 2049 bp, Artificial Sequence
  Synthetic construct ProSavinase S135
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 80 - DNA, 2049 bp, Artificial Sequence
  Synthetic construct ProSavinase T148
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 81 - DNA, 2049 bp, Artificial Sequence
  Synthetic construct ProSavinase S166
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 82 - DNA, 2049 bp, Artificial Sequence
  Synthetic construct ProSavinase T167
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 83 - DNA, 2049 bp, Artificial Sequence
  Synthetic construct ProSavinase S196
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 84 - DNA, 2049 bp, Artificial Sequence
  Artificial construct ProSavinase S208
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 85 - DNA, 2049 bp, Artificial Sequence
  Synthetic construct ProSavinase S239
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 86 - DNA, 2049 bp, Artificial Sequence
  Synthetic construct ProSavinase T243
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 87 - DNA, 2049 bp, Artificial Sequence
  Synthetic construct ProSavinase S269
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 88 - DNA, 2049 bp, Artificial Sequence
  Synthetic construct ProSavinase T285
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 89 - DNA, 2049 bp, Artificial Sequence
  Synthetic construct ProSavinase S293
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 90 - DNA, 2049 bp, Artificial Sequence
  Synthetic construct ProSavinase S317
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 91 - DNA, 2049 bp, Artificial Sequence
  Synthetic construct ProSavinase T318
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 92 - DNA, 2049 bp, Artificial Sequence
  Synthetic construct ProSavinase T329
caaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtcgcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagagatgttgagactggagaggttctctgggaccctattgttgctgtcgaaccggccggtaaggcgagaacattcgacttgcgcgttccaccctttgcaaacttcgtgagcgaggacctggtggtgcataacactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaagacgtcgcgc

SEQ ID NO: 93 - DNA, 609 bp, Artificial Sequence
  Synthetic construct NI-1
atggctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagtgcctttctttcggaactgagatccttaccgttgagtacggaccacttcctattggtaagatcgtttctgaggaaattaactgctcagtgtactctgttgatccagaaggaagagtttacactcaggctatcgcacaatggcacgataggggtgaacaagaggttctcgagtacgagcttgaagatggatccgttattcgtgctacctctgaccatagattcttgactacagattatcagcttctcgctatcgaggaaatctttgctaggcaacttgatctccttactttggagaacatcaagcagacagaagaggctcttgacaaccacagacttccattccctttgctcgatgctggaaccatcaagtga

SEQ ID NO: 94 - DNA, 930 bp, Artificial Sequence
  Synthetic construct IC-1
atggttaaggtgattggaagacgttctcttggtgttcaaaggatcttcgatatcggattgccacaagaccacaactttcttctcgctaatggtgccatcgctgccaattgcactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatga

SEQ ID NO: 95 - DNA, 729 bp, Artificial Sequence
  Synthetic construct NI-2
atggtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttgcctttctttcggaactgagatccttaccgttgagtacggaccacttcctattggtaagatcgtttctgaggaaattaactgctcagtgtactctgttgatccagaaggaagagtttacactcaggctatcgcacaatggcacgataggggtgaacaagaggttctcgagtacgagcttgaagatggatccgttattcgtgctacctctgaccatagattcttgactacagattatcagcttctcgctatcgaggaaatctttgctaggcaacttgatctccttactttggagaacatcaagcagacagaagaggctcttgacaaccacagacttccattccctttgctcgatgctggaaccatcaagtga

SEQ ID NO: 96 - DNA, 792 bp, Artificial Sequence
  Synthetic construct IC-2
atggttaaggtgattggaagacgttctcttggtgttcaaaggatcttcgatatcggattgccacaagaccacaactttcttctcgctaatggtgccatcgctgccaattgctcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatga

SEQ ID NO: 97 - DNA, 987 bp, Artificial Sequence
  Synthetic construct NI-3
atggctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttgcctttctttcggaactgagatccttaccgttgagtacggaccacttcctattggtaagatcgtttctgaggaaattaactgctcagtgtactctgttgatccagaaggaagagtttacactcaggctatcgcacaatggcacgataggggtgaacaagaggttctcgagtacgagcttgaagatggatccgttattcgtgctacctctgaccatagattcttgactacagattatcagcttctcgctatcgaggaaatctttgctaggcaacttgatctccttactttggagaacatcaagcagacagaagaggctcttgacaaccacagacttccattccctttgctcgatgctggaaccatcaagtga

SEQ ID NO: 98 - DNA, 552 bp, Artificial Sequence
  Synthetic construct IC-3
atggttaaggtgattggaagacgttctcttggtgttcaaaggatcttcgatatcggattgccacaagaccacaactttcttctcgctaatggtgccatcgctgccaattgctcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatga

SEQ ID NO: 99 - DNA, 1065 bp, Artificial Sequence
  Synthetic construct NI-4
atggctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattgcctttctttcggaactgagatccttaccgttgagtacggaccacttcctattggtaagatcgtttctgaggaaattaactgctcagtgtactctgttgatccagaaggaagagtttacactcaggctatcgcacaatggcacgataggggtgaacaagaggttctcgagtacgagcttgaagatggatccgttattcgtgctacctctgaccatagattcttgactacagattatcagcttctcgctatcgaggaaatctttgctaggcaacttgatctccttactttggagaacatcaagcagacagaagaggctcttgacaaccacagacttccattccctttgctcgatgctggaaccatcaagtga

SEQ ID NO: 100 - DNA, 474 bp, Artificial Sequence
  Synthetic construct IC-4
atggttaaggtgattggaagacgttctcttggtgttcaaaggatcttcgatatcggattgccacaagaccacaactttcttctcgctaatggtgccatcgctgccaattgctccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatga

SEQ ID NO: 101 - DNA, 1074 bp, Artificial Sequence
  Synthetic construct NI-5
atggctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttgcctttctttcggaactgagatccttaccgttgagtacggaccacttcctattggtaagatcgtttctgaggaaattaactgctcagtgtactctgttgatccagaaggaagagtttacactcaggctatcgcacaatggcacgataggggtgaacaagaggttctcgagtacgagcttgaagatggatccgttattcgtgctacctctgaccatagattcttgactacagattatcagcttctcgctatcgaggaaatctttgctaggcaacttgatctccttactttggagaacatcaagcagacagaagaggctcttgacaaccacagacttccattccctttgctcgatgctggaaccatcaagtga

SEQ ID NO: 102 - DNA, 465 bp, Artificial Sequence
  Synthetic construct IC-5
atggttaaggtgattggaagacgttctcttggtgttcaaaggatcttcgatatcggattgccacaagaccacaactttcttctcgctaatggtgccatcgctgccaattgctcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaacacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatga

SEQ ID NO: 103 - DNA, 1236 bp, Artificial Sequence
  Synthetic construct NI-6
atggctcagccagctaagaacgtggagaaggattacatcgtcggcttcaagagcggcgtcaagacagcttctgttaagaaggacatcattaaggagagcggcggcaaggttgataagcaattcagaatcattaacgcggccaaggctaagctcgacaaggaggcgcttaaggaggtgaagaatgacccggatgttgcctacgtggaggaggatcacgtcgcccatgctctggcgcagactgttccgtacggcatcccactcattaaggccgacaaggtgcaggctcaaggcttcaagggcgcgaacgtgaaggtcgccgttcttgacaccggcatccaagcttcacaccctgatctgaatgtggtcggaggagcttcgttcgtcgctggagaggcctacaacactgacggaaatggccacggcacccatgtggctggcactgtcgctgcgcttgataacaccactggagtcctgggcgttgctccatcagtgtcgctgtacgctgtgaaggtcctcaactccagcggctccggcagctactctggcatcgtgtctggcattgagtgggctacaacgaacggcatggacgtcattaatatgagcctcggcggagcttcaggatcgaccgcgatgaagcaggccgtcgataacgcctacgctagaggcgttgtggtcgttgccgctgcgggcaattccggctcttcaggcaacaccaatactatcggctacccggccaagtacgactctgtgattgctgtcggcgcggttgattccaacagcaatcgggcgtcattctcgtccgttggagctgagctcgaggtcatggctcctggagctggcgtgtactccacctaccccacaaactgcctttctttcggaactgagatccttaccgttgagtacggaccacttcctattggtaagatcgtttctgaggaaattaactgctcagtgtactctgttgatccagaaggaagagtttacactcaggctatcgcacaatggcacgataggggtgaacaagaggttctcgagtacgagcttgaagatggatccgttattcgtgctacctctgaccatagattcttgactacagattatcagcttctcgctatcgaggaaatctttgctaggcaacttgatctccttactttggagaacatcaagcagacagaagaggctcttgacaaccacagacttccattccctttgctcgatgctggaaccatcaagtga

SEQ ID NO: 104 - DNA, 303 bp, Artificial Sequence
  Synthetic construct IC-6
atggttaaggtgattggaagacgttctcttggtgttcaaaggatcttcgatatcggattgccacaagaccacaactttcttctcgctaatggtgccatcgctgccaattgcacgtacgcgacacttaatggcacgtcgatggtttccccacacgtggctggagctgctgctctgatcctcagcaagcatccaaacctgtctgcctcacaggtcaggaatcgcctcagctctaccgctacttaccttggctcatcgttctactacggcaagggcctcattaacgttgaggccgctgcgcaatga

SEQ ID NO: 105 - DNA, 1362 bp, Artificial Sequence
  Synthetic construct VMA codon optimized
tgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataat

SEQ ID NO: 106 - DNA, 1269 bp, Artificial Sequence
  Synthetic construct Tth codon optimized
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataac

SEQ ID NO: 107 - DNA, 2505 bp, Artificial Sequence
  Synthetic construct VMA1
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 108 - DNA, 2505 bp, Artificial Sequence
  Synthetic construct VMA2
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatcctgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataatactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 109 - DNA, 2505 bp, Artificial Sequence
  Synthetic construct VMA3
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 110 - DNA, 2505 bp, Artificial Sequence
  Synthetic constuct VMA4
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 111 - DNA, 2505 bp, Artificial Sequence
  Synthetic construct VMA5
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 112 - DNA, 2505 bp, Artificial Sequence
  Synthetic construct VMA6
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccaattctttatgagaatgaccactttttcgactacatgcaaaaaagtaagtttcatctcaccattgaaggtccaaaagtacttgcttatttacttggtttatggattggtgatggattgtctgacagggcaactttttcggttgattccagagatacttctttgatggaacgtgttactgaatatgctgaaaagttgaatttgtgcgccgagtataaggacagaaaagaaccacaagttgccaaaactgttaatttgtactctaaagttgtcagaggtaatggtattcgcaataatcttaatactgagaatccattatgggacgctattgttggcttaggattcttgaaggacggtgtcaaaaatattccttctttcttgtctacggacaatatcggtactcgtgaaacatttcttgctggtctaattgattctgatggctatgttactgatgagcatggtattaaagcaacaataaagacaattcatacttctgtcagagatggtttggtttcccttgctcgttctttaggcttagtagtctcggttaacgcagaacctgctaaggttgacatgaatggcaccaaacataaaattagttatgctatttatatgtctggtggagatgttttgcttaacgttctttcgaagtgtgccggctctaaaaaattcaggcctgctcccgccgctgcttttgcacgtgagtgccgcggattttatttcgagttacaagaattgaaggaagacgattattatgggattactttatctgatgattctgatcatcagtttttgcttgccaaccaggttgtcgtccataattctaatgtacaaattcgaaatcatctaaagaatacggcaactagtttaggaagcacgaacttgtatggaagcggacttgttaacgcagaagcggcaacgcgttaa

SEQ ID NO: 113 - DNA, 2412 bp, Artificial Sequence
  Synthetic construct Tth1
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 114 - DNA, 2412 bp, Artificial Sequence
  Synthetic construct Tth2
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 115 - DNA, 2412 bp, Artificial Sequence
  Synthetic construct Tth3
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 116 - DNA, 2412 bp, Artificial Sequence
  Synthetic construct Tth4
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 117 - DNA, 2412 bp, Artificial Sequence
  Synthetic construct Tth5
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 118 - DNA, 2412 bp, Artificial Sequence
  Synthetic construct Tth6
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaagaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataactctaatgtacaaattcgaaatcatctaaagaatacggcaactagtttaggaagcacgaacttgtatggaagcggacttgttaacgcagaagcggcaacgcgttaa

SEQ ID NO: 119 - protein, 329 aa, Artificial Sequence
  Synthetic construct mTth:EU59 intein
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHN

SEQ ID NO: 120 - protein, 682 aa, Artificial Sequence
  Synthetic construct ProSavinase S46
AEEAKEKYLIGFNEQEAVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 121 - protein, 682 aa, Artificial Sequence
  Synthetic construct ProSavinase S62
AEEAKEKYLIGFNEQEAVSEFVEQVEANDEVAILCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 122 - protein, 682 aa, Artificial Sequence
  Synthetic construct ProSavinase T77
AEEAKEKYLIGFNEQEAVSEFVEQVEANDEVAILSEEEEVEIELLHEFECLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 123 - protein, 682 aa, Artificial Sequence
  Synthetic construct ProSavinase S86
AEEAKEKYLIGFNEQEAVSEFVEQVEANDEVAILSEEEEVEIELLHEFETIPVLSVELCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 124 - protein, 682 aa, Artificial Sequence
  Synthetic construct ProSavinase S100
AEEAKEKYLIGFNEQEAVSEFVEQVEANDEVAILSEEEEVEIELLHEFETIPVLSVELSPEDVDALELDPAICLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 125 - protein, 682 aa, Artificial Sequence
  Synthetic construct ProSavinase T109
AEEAKEKYLIGFNEQEAVSEFVEQVEANDEVAILSEEEEVEIELLHEFETIPVLSVELSPEDVDALELDPAISYIEEDAEVCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 126 - protein, 682 aa, Artificial Sequence
  Synthetic construct ProSavinase S135
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 127 - protein, 682 aa, Artificial Sequence
  Synthetic construct ProSavinase T148
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 128 - protein, 682 aa, Artificial Sequence
  Synthetic construct ProSavinase S166
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 129 - protein, 682 aa, Artificial Sequence
  Synthetic construct ProSavinase T167
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 130 - protein, 682 aa, Artificial Sequence
  Synthetic construct ProSavinase S196
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 131 - protein, 682 aa, Artificial Sequence
  Synthetic construct ProSavinase S208
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 132 - protein, 682 aa, Artificial Sequence
  Synthetic construct ProSavinase S239
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 133 - protein, 682 aa, Artificial Sequence
  Synthetic construct ProSavinase T243
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 134 - protein, 682 aa, Artificial Sequence
  Synthetic construct ProSavinase S269
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 135 - protein, 682 aa, Artificial Sequence
  Synthetic construct ProSavinase T285
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 136 - protein, 682 aa, Artificial Sequence
  Synthetic construct ProSavinase S293
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 137 - protein, 682 aa, Artificial Sequence
  Synthetic construct ProSavinase S317
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNSTYASLNGTSMATPHVAGAAALVKQKNPSWSNVQIRNHLKNTATSLGSTNLYGSGLVNAEAATR

SEQ ID NO: 138 - protein, 682 aa, Artificial Sequence
  Synthetic construct ProSavinase T318
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSCLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTYASLNGTSMATPHVAGAAALVKQKNPSWSNVQIRNHLKNTATSLGSTNLYGSGLVNAEAATR

SEQ ID NO: 139 - protein, 682 aa, Artificial Sequence
  Synthetic construct ProSavinase T329
AEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMACLAEGSLVLDAATGQRVPIEKVRPGMEVFSLGPDYRLYRVPVLEVLESGVREVVRLRTRSGRTLVLTPDHPLLTPEGWKPLCDLPLGTPIAVAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVSRDVETGEVLWDPIVAVEPAGKARTFDLRVPPFANFVSEDLVVHNTPHVAGAAALVKQKNPSWSNVQIRNHLKNTATSLGSTNLYGSGLVNAEAATR

SEQ ID NO: 140 - protein, 700 aa, Artificial Sequence
  Synthetic construct intein-modified proSavinase_S135:Aae_RIR2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFIEGTEVLTKRGFVDFRELREDDLVAQYDIETGEISWTKPYAYVERDYEGSMYRLKHPKSNWEVVATEGHEFIVRNLKTGKERKEPIEKVKLHPYSAIPVAGRYTGEVEEYDLWELVSGKGITLKTRSAVKNKLTPIEKLLIVLQADGTIDSKRNGKFTGFQQLKFFFSKYRKINEFEKILNECAPYGIKWKKYERQDGIAYTVYYPNDLPIKPTKFFDEWVRLDEITEEWIREFVEELVKWDGHIPKDRNKKKVYYYSTKEKRNKDFVQALCALGGMRTVVSRERNPKAKNPVYRIWIYLEDDYINTQTMVKEEFYYKGKVYCVSVPKGNIVVRYKDSVCIAGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 141 - protein, 507 aa, Artificial Sequence
  Synthetic construct intein-modified proSavinase_S135:Ace_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCQPYSAPVSTPDGPIPIGKLVDANAVGEKVFDASGVTRIVATTCNGRKPVLRIRTSGGHVLDVTPDHLVWQVVDQTAGRFVPAGQLRVGDRLEWHDRANSDAMVAAFTADSAAAAQPGQIVDILAIDELGVMPVYDIQTESGEYLSDGIRVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 142 - protein, 772 aa, Artificial Sequence
  Synthetic construct intein-modified proSavinase_S135:Aeh_DnaB-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTGDTRVLLADGQRVPIRDLVGQTPEVISVNAEGRLEPAKTDLVWSVGVRPLLQVRLASGRTIRCTPEHRLRGLWDWKEARDIRVGDRLGIARELPAPKVTKRWAEHELVLLAHLVGDGSYIKGQPLRYTTASEANSEAVSRAAEAMGSTVTRHPGRGQWHQLVISGNGNRWHPQGVGKWLKQLGVFGQRSREKHLPQEVFQLDNDQLALFLRHLWATDGSITQGSAGRPRIYFSTASRHLIQDVAALLLRFGIVGRTKHITHGDGEGWFTLDISGAVQQQRYLEKIGAFGHQAHNARRALQHLRGLVENTNVDTLPEEVFNYIRERMREEGITHRQMAALRGTAYGGSAHFTFSPSRETLLSYADILNDQRLRMLANQHVFWDRVVSVEPAGEEEVFDLTVPGNACWLADGIVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 143 - protein, 959 aa, Artificial Sequence
  Synthetic construct intein-modified proSavinase_S135:Ani-FGSCA4_PRP8
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLANGTQLLRYDGTKVNVEDVKEGDLLLGPDGGPRRAFNVVSGKDRLYRIKIDGDKEDLVVTANHILVLHRAKAMNTSVCFDRSKEQQGGAGEQLDISEVSAAERYDTVEMTAAEFAALHPQERSWYRAIRCPGFELPEQDVPVNPYFLGLWLGDESRNQSAIYSNHEEALREFLVSHAAELDMHLVYHGQSAYSTVCNKDRPTNKRIGPANQTQTVRPTIRQTRRTIRQQRLAAEHAAAEYTTQRETASLTPLLESPTSDKHGLLSSVETPGRLSDSVTTELPMSRSASAMRSIRTASGLSEFNDVTNVSASMPDIQNSGIKNQGRIAKVTRQQDSKGEVDFRQQYSQAIKDDLELLETDIEDDVASSDEIEDVCVVGSENELIGSEKQDQSGRRRQIHRLRTGHRGYGDLSDDEQEQLLDSVVERYAGDSRLNTLQQELSKMGILNPETGPINDKKRIPQVFMQNSRSVRLSVLAGLLDSDGWYIYPENMFGFAQSELCHKELFWDVVTLARSLGFGVWTKKRMMPDPTGKRMSPMLVAQISGDLAEIPCVLARKKAMPRLIPQSHSFAIKDISLESEATEWAGFRVDKDQLYLRHDYVVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 144 - protein, 822 aa, Artificial Sequence
  Synthetic construct intein-modified proSavinase_S135:Ape_APE0745
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSLPPWEPIVVRRGDEVRVTSIGEFVDSFLEGEGGLDIGGLGYYTLSLDTRTLKPVWRRIRGVIKHRIRGRLLRVKASKGRSIDLTGSHSIYRISRGGGLEVVGSSDLRPGDSLVTPASVELPESAPSSINAARELWSRGVEGIFVVGLPGEAAGYRGVERSRGYDGGHAIPLETLVERYGDSVWSLVSGAKLAVSRGAAGDHPVPATIPLDTGFYLLLGFIVSAGSVDVEGGHVTVTLGPGREGYVGDVVEAVNSTAPGAGVRISSGARGMEVTIRSRVLSELLARVFGAGPGPNRDIPSIVFRAPKPMKRVFLKGLYAGGGVFDRSSGSLIYATDSRSLLNGLALLLLNVGAGGYRIDSGDSGRALALIVENAGRLDAIGEVLEHLGFHGGREAVQGVGALERATAGLAGQATVAVQRPATRGGPGVDVAGVTGLEHLEASTEFVYDLSVEGDENFFAGLGWILVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 145 - protein, 732 aa, Artificial Sequence
  Synthetic construct intein-modified proSavinase_S135:Avin_RIR1_BIL
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAPETLVHTADGPRPIRDLQQGDLVLGISGRYREVTHKFVYNQTDAMLAIRVKHAVEPIEVTAGHPFYAIRGVPLEQSGERTLRQLESGKRSPEWIDAGELERGDYMAQVIPSEVVPVAGFDEDDARLYGILLGDGHLSKNGLQWGVSGHPQRDGHMDFVRAYLSARGIHFWETARDETYGQIHWASGRGVRRDATTGRITGAGAATLPFEHADLYDEQGRKRIARRFSHLPRQQSLALIRSLLESDGGVSRGKEIYFTNTSRPLIEGLRYQLLRLGVPTAGQYRERRQDHVGQRADGSPIRFEGVCKAYDLRIPAVPEVAQLVGCQPIAKRNWITWQGCVYSRIRDVQPIAVKPFVFDLKVEGDESYMTTSGLAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 146 - protein, 842 aa, Artificial Sequence
  Synthetic construct intein-modified proSavinase_S135:Bde-JEL197_RPB2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLSGDTEVVLGNGMDVVLLTDLVDGACVSTIEPRTGVVSPSLIDHYFAKDATRVLKITLDDGRVIKADPEHPLFAAKVDETTRGLTGQWLRVEELTVGHHALLVSPQQAYCTSEQWTLTLSEKEVCTASTAQLAKQLSEIGLVGVPIPLSKVKSAARLFGLVLSAGDFSGKLYVEKDEDVTAVNSDLTALGFSPAHWVRYQDDQQKWFKCDDSNGKAICITLVPTANALLQTLGAHDAEKQHRYCLLPKWLLDAPTSIKREFLGALFGGNGAHITISCNEGKWEPTMSALTQHTDADHLESTVVYLKQVATLLGMLNICSSVSSEKHITAEKTGYAVHLHVDNTAENLVRFYEQVGYRYCFNKTSQSSAPVQWIKGSLFFIEQHRSKCQHAFELLHTGLGTKAAVSAEINMPHHNPSHMLNVKEIPTAPADEYITWIEFKDRYVHKESPRFVWVTIHSIEEAPAERLYDFNTVSQNHSFFANSIVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 147 - protein, 773 aa, Artificial Sequence
  Synthetic construct intein-modified proSavinase_S135:Bde-JEL423_eIF-5B
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFGRDTPLLMADGTTKFVQDIKALDQLMGDDCTPRIVQERSLVHESGALYRVVPKNANGHDAFVCNKEHILVMVNVKQPWVSQTVIDGVDQFHVSEVVCIGNIPTVRSSGNFASAVEATKALPAWTLLIWEISVLEYLAVDADLRQHFMIYKPAGGIEYPTTTNLDIVQHFGAESVPNLEHAVMWCIGLWILLGDVDTAGNPVLILSGIDHLHPLIKTLHSHSQKLSISFTNQLDEGVADISKPTIIALGDKFGLLFKSLGIESAECIPDALLRSSKLHRAALLAGLVEGSNAFSIVKDTPKHWDISCKNNMIFENIKRLSSSLGLCVDTVTPATITQQVSVKTLQIRISGPRMHYVSELISNDSLKTTSVVSIDSWLNVKSNACEFEIESIGCGEYFGFTVMGPNSRFLLGDFTVTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 148 - protein, 739 aa, Artificial Sequence
  Synthetic construct intein-modified proSavinase_S135:BsuP-M1918_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTGETLLLTENGYEKAADLYKKQNNLKVVIDNRTKDFAVDSKGTTIVDAIPMQLTKKDAEIFKVKTKQGYEIRATEWHKFYVKRDGEIQKLQLNQLKTGDKLLVQSAEGAYGKIHEPDLAYIMGIIAGDGTITEKTAKIYLYDNKKVLEQKVTDAVHRIIHKHKVDRAYKHNTSLLPTFNMANPEKQDLLYMNSTVLFDILKKFGMNKERKTRVPEFIFQANKETQAAYLSGLFQTDGCVNANHKAKALTIELTSIHYESLQDVQKLLLNMGVYTTIYSNNKRSQELLPDGKGGSKLYNVKPTHKISIQDRNSRELFMSIVELKDYDVYKFNLLTETLQPKSRKPKHDFTAEIISIEEDGVEDVYDTTQEDYHSLIFNGIVTGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 149 - protein, 724 aa, Artificial Sequence
  Synthetic construct intein-modified proSavinase_S135:Cag_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTADTLIATDRGLERIGNIVGESRGIKSIDGKLHWVENIFPTGTKPVYQLRTKSGYQLKLTGDHVVFTENRGDVKACELRKDDMVRLVGAPFGKETTGSTDIAQLIGLLTGDGCITTANEIAASGEQRRTAFLTVSKAEQEIAEWANQFINTLRPELGEHNKSGSVTETATTARVAVGSPRILKQFEAFAVLDKGSVHKLFTDKVFQLAQSEQAALLRGLFTADGTVANYSDKSQYIALDATSLELLQQVQLLLFNFGIKSKIYENRRVGELVSLLPDGKGGIKEYPVQQMHSLRISRSSRILFEQQIGFMAESKKYEALAELNRTVSTYRDSAYDAVASLTYSGEEAVFDLTEPETDHFIANGIGVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 150 - protein, 630 aa, Artificial Sequence
  Synthetic construct intein-modified proSavinase_S135:Cau_SpoVR
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLHGDSLIVTDHGLVPMREVVNHRQRLQVSDGERQQTVYDWNRFADYPTVTMRTRAGFTLTGSHNHRIMLADGTWRRLDELQIGDRVRIAGGTELWATEPALLRCRRPLPRVLVTAGAPAATTSSPHRRGYRRAAAVVVDEKLAAAIGRRCVTHADQQALDAIRRSPRPQVVAFLRAFCQGAGQSVASGLTLTCADADLATTVQLLLTNLGVLAHRTDTTVRIDNGDDLERAYTTLATPTGWTDEVVALEHGTADVYDISVTATHRYAAQGFINHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 151 - protein, 500 aa, Artificial Sequence
  Synthetic construct intein-modified proSavinase_S135:Cbu_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTGDTLICLADGRRVPIQDLVGHSPEVIAVDDKGRLVCAKSEVIWKVGERSVFEIKLASGRSIKATAEHRLLAFKGWRHVKDFKVGDRLAIAHQVPEPDRLLQHCQSDLFWDRIVSIEEKGSEEVYDLTVPKYASWLADGVVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 152 - protein, 810 aa, Artificial Sequence
  Synthetic construct intein-modified proSavinase_S135:Ceu_ClpP
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTSDHTVLTTRGWIPIADVTLDDKVAVLDNNTGEMSYQNPQKVHKYDYEGPMYEVKTAGVDLFVTPNHRMYVNTTNNTTNQNYNLVEASSIFGKKVRYKNDAIWNKTDYQFILPETATLTGHTNKISSTPAIQPEMNAWLTFFGLWIANGHTTKIAEKTAENNQQKQRYKVILTQVKEDVCDIIEQTLNKLGFNFIRSGKDYTIENKQLWSYLNPFDNGALNKYLPDWVWELSSQQCKILLNSLCLGNCLFTKNDDTLHYFSTSERFANDVSRLALHAGTTSTIQLEAAPSNLYDTIIGLPVEVNTTLWRVIINQSSFYSYSTDKSSALNLSNNVACYVNAQSALTLEQNSQKINKNTLVLTKNNVKSQTMHSQRAERVDTALLTQKELDNSLNHEILINKNPGTSQLECVVNPEVNNTSTNDRFVYYKGPVYCLTGPNNVFYVQRNGKAVWTGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 153 - protein, 699 aa, Artificial Sequence
  Synthetic construct intein-modified proSavinase_S135:Chy_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTGDTLVFTDKGLIEARKLEVGMKVWSGDGWNEIKEVINNGVKPVLKLKLKTGLEIKVTEEHKIFTGEGWKEAKDLKVGDKLYLPVSYPELDFPVKEENDFYEFLGYFLGDGSLSVSNHVSLHVGNDKELALYFKEKVEKYAGAAYLIERDGQYIIDVHRKEFAEKIKKIFGIEITDSKEKDIPSSLLAVNSEAMKALLRGLFSADGSVYDANGSITVALSSTSYPLLRKVQILLLSLGIPSTLTGEKDQDVKIIKGNEYETLPTYRLIISGERASLFFNKIGLIGEKKKKFLELMAGKTTYSTLNNHLYQEIVSIEPAGEEEVFDITAPPKYTWITNGILSLDSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 154 - protein, 489 aa, Artificial Sequence
  Synthetic construct intein-modified proSavinase_S135:Cth_ATPase_BIL
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFVAGTMILTVAGLVAIENIKAGDKVIATNPETFEVAEKTVLETYVRETTELLHLTINGDVIKTTFEHLFYAKDVGFVEAKELQVGDKLLDSKGNVLVVEDKKIKITDEPVKVYNFQVDDFHTYHVGCNGVLVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 155 - protein, 687 aa, Artificial Sequence
  Synthetic construct intein-modified proSavinase_S135:Cth_TerA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGQLALDTPIPTPDGWTTMGEIKAGDKVIDEKGRPCNVVAISEIDDTEQAYKINFRDGTSIVAGERHLWKVQVTNNGRREKLLTTGEMYQKQFKTKSKENRALFRIPIADAFILPENKLPIDPYLFGYWIGNGNAVKPEITVMRDDVDEVIKNIPYKLHNRYKQEGNSDILVYKELKSILVKNFREKRIPIEYLRASAQQRKRLLQGLIDSDGCVSTAKSQAIYVTILFELAKDVQDLLWSLGIKNTLKTAPSARYGIETGEICYLIKFTAFNDLEVSGLDRKLKRGRERNIKTRSHFHYIKSIEKTGKTKMRCIQVDSPSRLYLAGKSMIPTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 156 - protein, 690 aa, Artificial Sequence
  Synthetic construct intein-modified proSavinase_S135:CV-NY2A_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVAGDTKILTSSGYHPIKDMEGKQVRVWNGYEFSETIVHKTGVNQKLIMVSLDDGTELRCTPYHKFYIETGSRPADKSRVMEVRAGDLEKGDRIIRFELPTITVGETTMSDKEAYTKGFFSADGCVIKSKYGEDEYRISVKREDKIEALTKYVDVIKSHTNRFRTHFYVPDYVQNKFEVPINSMVNEKISWLAGFMDGDGCVIRYKDIENMQAVSINKSFLQDIRLMLQTIGIHSTINKFMPNRVMKMPDGRGGTDMYNGAESWRLQIDSEGVRKLFALGFTPRRLKMNGSRKRHHKTNKFTRVVSVTDHGDVEDTYCFNEPKRHMGVFNGVITGQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 157 - protein, 748 aa, Artificial Sequence
  Synthetic construct intein-modified proSavinase_S135:Cwa_PEP
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFDGKTKILTNQGFMTLRQVYEQGYEGLSTLSLNTKTHKIEWKPILDTMKRQSEMIDISVSQTGRITDNTLRLTPDHKMVNLRGGKYTKTEIQDLLKQQEMLTVAQTIPSLGNNKHQEADLAYFLGGIITDGSIYTSSTRGEVQFIQKDVPEKQAFISKMNDLANSLYGKSFTAHIKPVSSSYIRGQKVTGQATAYRLHSKAIAYDVKERENNITQLLLENEAELSYHFLGGVIDGDGCYHKNRLHIYISEENLLQAVIIACLKMNTVPQVTKNRNIYHLQIVEKLEVILRYTQRVKGEVTPRTIQTRFFATRQLFENQETGQIKLRQDNNCLISDKQLREMGEFEELIDGDTRMQRVIQVGEKSDGDVYNITVAEHHNYVVFTAKYTPVVVCNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 158 - protein, 701 aa, Artificial Sequence
  Synthetic construct intein-modified proSavinase_S135:Cwa_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVAPETKILTDRGQIAIADVAGEKVNIWNGSEWSEVLVKKTGENQPLLKVHFSNGESLDCTYYHKFHVQENYKGKVKIVEAKDLQEGDKLIKYRLPLVESENDIDFPYAYTSGFFSGDGSHDGMGKPEIDLYGEKKELLPFVTVRNKYYGGSYGDKSWRIERDEVAVYDDVNQDRIVCKLPLDIPAKFTVPVNGYTIQSRLEWLAGLLDADGTVARNGDNESLQVASTHQQFLLDIRLMLQTLGVDSKVVKMDEMGYRSLPDGKGGYQDYFCQAKYRLLISSNGLFQLGELGLKTNRLQWNLREPQREASQFIRVEKVELTCRYDDTYCFSEPKRHLGMFNGILTGQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 159 - protein, 961 aa, Artificial Sequence
  Synthetic construct intein-modified proSavinase_S135:Dhan_GLT1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLASDTLVRTSEGDKPVAEVAIGDYLLDAEDKPVLCMGANPSQTGRMKEIAYQDFDSKKRVSFKCTPDHHLELTLTDSTPSLSGKSVTWFSRCTGAHLSEEVSEVYLDNMVSIFYNDLVDSTDSAVDKDSIHEAVDLALEDHYHRGNSDQYSIHLNEYISRIADKELQNEPEFIRECIHDAANRFVITSSGNRNIKSESFDDKLLLSRSRSSTADSDSDYVITDASVHSHSNNSSVYLASPDSMIPDGAANRFENIASKLKEPVCNCGGIRKIFRSFGTTEDAELAYSLLLSEHYYRLDPRFVTDGYTFQASVEQYENMCSQEVQNMHLKLYRSPLKFVEREHNSAELPVDPYFLGLWLGDGDSSGTTIMTTDREIVVWLNSYVERLNQNKPEGCFPLKLTEQLIYGAGHTSKSGHTTKVDVRNYKISSGDAFVRSGTYWNPIFDGLKKLGLLNNKSAGIPQEYMNSDEQNRLSVIAGLMDSDGCYVKSHNTYRFTQLTEDHKKIVYDLKELALSCGINTTGVELSVKPLGFNKHKHSTEYVVYLGNGSQKFQELLLLPRKKMEISKKHVSLDARPFTVSDVEDGEFRAIEVSGGVFQLANRLVVANSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 160 - protein, 648 aa, Artificial Sequence
  Synthetic construct intein-modified proSavinase_S135:Fsp-CcI3_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCQPYDALVSTPSGLVPIGALVETDAVGMKVFDAHGLTQVIATKSNGVKDVLRIWTRAGHALDVTADHLVWRSTSAGAGAFVPAGALRAGDTLEWHRTIAPGEGEITSREIAEAALAGRLQADGFVGRYAGTNASLTIEAMTVPTRLYDAPLPVVAAYLRSLFQADGYVSRRERSTLIGLDMISEGLIRGVQGLLARFGIFARVRREADPRPDRHDLWSLGIQNAGDRRTFADEIGFLDPVKAAKLEASFDQPGQAAKPVKRLQIERIEPRGPMPVYDIQTDSGEYLSAGLRVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 161 - protein, 800 aa, Artificial Sequence
  Synthetic construct intein-modified proSavinase_S135:Gob_DnaE
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVVAGTEVTDAETGAVVTVGELFESRRAVTVHALGADSKLRPRPVTDVVWNGRKRVYRLTTELGKSITATDNHPFRVLDGWKNLGELKPGDRIAAPRRLAVPSAGTWPQHEIVALAGLLSEGNTCHPTTLYFYGNDRVLIDDFARAIGQFPDTVAKVYARPNRRNLEVRANTGRDTRLKSRAERDAAVALLAPPTRSGAFVWAQRLGILGKTATEKFVPHDVFRLCDSDLELFLGRLWAGDGFIANDTLKVPFYATSSRRLAQDVQHLLLRLGIVGRIHEKQFKYKGGLKPGFTVHLIGDGAAEAFLDRIAPHCLGREHAVTILREHVATTARGLTSKDTVPLEVRAWVDDGRRARGLTWDELEQQSDVSTQEFYGTPAPGKKGFRRATIAKLAAFFGSQRLAAVADSDVFWDRVVSIEYAGVQDTYDLTVDEDHNFVANGLIVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 162 - protein, 641 aa, Artificial Sequence
  Synthetic construct intein-modified proSavinase_S135:Gob_Hyp
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCQPAGTQVAKVIKEGRWREDSVIEQVPIESLQPGDRVVSFGNAKIYRRGRAVTGITSRRHTGNLHRVEVGEFRTRATPEHRFTVRFDPARPKAGLLYLMRRGDRWRVGVCGMFNSRGFGVSVRLSQERGDAAWVLGAFATLTEARIAEQVVSCRYGIPTTVWETGRNPGASWAQRDQAGIDAIYQRLGVDRIRAGVDRLLRDHGLSAGLPLLAANEPGNFSCRQSRQVAACNLVPGVMQVPVPTAGERFEWRDLTATSFERVHDLEVWSMDVERDKHYVADGIVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 163 - protein, 766 aa, Artificial Sequence
  Synthetic construct intein-modified proSavinase_S135:Gvi_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAAGTLLHTEQGYVPVEQVVAGVGTRVCTHQGFRNISERFDNGEAEVFRVTTRKGYSVEVTANHKMARLDENGDLLLDELSHLQVGDNLLLLLGSNPVTEKVRLQCIPAGYRSSIEIAQPPELDEQLAYLLGYAYGDGCVGRGATYNYLSLAVSHTYPNVRDQLAAIIREKFGLTTKIYSGSGAVWNLLVHSANLLDWLKANGLLKQKAADLAMPEAILRSPSSVVGAFLSGYFDADGCVRGGKGGYGFDCTSKAFVGAVQLLLLAEGIVSNLHTTDRSRQGWRTIYRLNVCGTEFKRRFQTLCCRSAKVVHSPMVLGRDGTGGYPPALVRGASYQRVVAVGGKHLLYTALLKVIEKTRTAGKQALAESLCQHVNYFPDPIVAIESVGTQRVYDIEVEGMHLLGNGIYTSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 164 - protein, 846 aa, Artificial Sequence
  Synthetic construct intein-modified proSavinase_S135:Hhal_DnaB-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAYDAEIVQADGGVKTIEQIVRERRAHLATVGADWRLTWTEPCDYVDDGHKPVFEVTTRLGRRIETTLTHPFLTVHGWQRLEDLAEGDAIGVPRQLPVFGQEPIRDCEVRLLGHLIGDGGLTGSPPRLTSGQEAMTADFLEAVDAFGGVEAKPIRASRRTQSWVVVGAAQARAAARSSFASLVDALIRRSPLTGRAIARNLGVAPATLTYWRQGVNVPDAAMVGLLAGELGVDVGELRPEPVARRNDRNPLQAWLDRLGLAGKSAHEKTVPDCVFRLPREQLARFLNRLFSSDGWVTHLASGQGQIGYTTVSEALARQIQHLLLRFGVLAKLRHRSVRYQDGRRPAWQLDITHAESILTFAEQIGILGKEQRLASVAASVRGRRRQSHTDHIPCEIWQFIDRARGEWTWAELARRAGVASSNIHAYRRGMSRQRLAAFADALGSRELRQLASSDLYWDRIASIRPLGHKQVYDLTIPETHNFIANDVCVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 165 - protein, 831 aa, Artificial Sequence
  Synthetic construct intein-modified proSavinase_S135:Hma_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVHGDTRVTLADGHERPIREVVESNLDDPKPVDDGVWDTVDFDVPSLQSDGTVATQNATKVWKRKAPETLYRIRTATGRELDVTPSHPLFVQSDGRFQARKAEELESGTHVAVPRKVSTNACNELDVTFRQSQAHNRIDLDLPPQWTPELARLIGYIVAEGYVEQRPDNTGYVSITNNDREVLDDAKSVLETLNLNVTERSSHEGKTARELLCSAGEFVSFLASLDETLLQSSAERRVPQDIMRASDNVVTGFIRGYIEGEGHVSTSQREITVASMSKPLLEDVRTLLVTQGITAQLQPRNNGSYRLRISGQSFHDYAEQIGFITARKTEACRQFEGTHGNTNLDIVPNLGPELRRIREALGLTQSECGLPRSTYQHYERGRRNPSRDSLESVLDAFETRLAEMNNDTPISDTARSDGGGTGSLRQDLNGLAALVEGDIAWDRIESIEPIEHDEKWVYDLEIEGTHNYLTNGVVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 166 - protein, 892 aa, Artificial Sequence
  Synthetic construct intein-modified proSavinase_S135:Hma_TopA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTADSDVLVRSENGDIERQTVDSLFSDGQVVLADGDTDIAVSKETPTVLSLDEATERVSEQESTLVSERPLRDDESVRTIETSRGAVTVTDDHPMYIRQDGEVTVRPASDIEAGTDLVAARRPPDTMVEPSDETVLSWETFAADCDKHSKLYGVDCGTELAAQRAARDESQTAFAERYGSYGSAVGKYERGEKDVPVWLLGELDIRPDRIHGLNYETSFENPFPLEWSPELAQVIGCLLGDGSIHRNDDENVVDVRYHNTDEALIERFARDIERLFDIEPTVTDRPGRESHHKRKYQVDVPSAVGRVLVCVLEAVTENGTPGLPDAVRPAFVGALFDDEGHISREGKAFISNTDHTLLTGVGEMLAEMGIETKLAPDQHKLHIRGRRNLEQFLDRIPIASDEKFYRGLDALDAYDVTTRKAELLEAIRQEPKTSAALAQTLGVTRGSVNKYLRELRESGHIEKQIEGSNRSLDENRTVQYVAADFEGSVYATLRGEPSSVTVEDVERREYDGPVYDLTVSENAPNFAVNGGAVVHNSSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 167 - protein, 536 aa, Artificial Sequence
  Synthetic construct intein-modified proSavinase_S135:Hsa-NRC1_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVRGDTTVALADGSEREIRDLVEANLDDPRPVDDGVWDGVDVAVPSLAADGRLVQRRATKVWKREAPETMYRVRTAAGHRLTVTPSHPLFVAGSHGPDAVRTEDLEVGQLVGVAPDGDGSGQVAPDGGVIRDAQPAPVGDAETVAWSAIESITEVEPDEEWVYDLEVEGTHSYLTDGVVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 168 - protein, 791 aa, Artificial Sequence
  Synthetic construct intein-modified proSavinase_S135:Hvo_PolB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSVTGDRPVVVRDPGGTVRILPIEDLFARGTTESEVLIAADGDVVASATPGKTRRALDGWDALSVNEDGEAEWQPIAQAIRHNTDKPVVNLQHKFGESTTTRDHSYVVPGEDGLTTVSPDDVAEPYRVSGVPDVEPVEQVDVYEVLRGYEREYEDGRSVGSDNSITKRKQIHADDEYVWFGHEHHRDVDSTVKVKRFVDIDSEDGAALIRLLGAYVPEGSASTGETATSKFGASLAESDREWLAQLQRDYSRLFENTTAGIITSDRRAERTVEYQTDTGGASVTYNDETLKLQMMNELAAVFFREFAGQTSRGKRIPSFVFHLPEEKQDLFLTLLVEGDGSREFPRYTEAYAQRNFDFETTSRELAAGLSMLLTQRGQKHSLKYRDSKDSYTIRTCSTYREGRDPVLTEADHDGYVYDLSVEENENFVDGVGGIVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 169 - protein, 569 aa, Artificial Sequence
  Synthetic construct intein-modified proSavinase_S135:Hwa_GyrB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFSGDTEIALASGDSITFESLVDAYERGETHYCYTIGDDGRIRIEEIMNPRVTQEDAALLAVTLDNGEVIRCTPDHEFMLRDGNYCEAQNLTDGQSLMPLYRTTTEMTETTETTETTGTAEMVKQPFAQNNWESVSQLANRYNRRHTTTDHIVETQQIQSQQQSQIETVQISERADVHNHTVISVESLTETADVYDLEVPVTHNFALASGVFVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 170 - protein, 563 aa, Artificial Sequence
  Synthetic construct intein-modified proSavinase_S135:Hwa_MCM-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 171 - protein, 926 aa, Artificial Sequence
  Synthetic construct intein-modified proSavinase_S135:Hwa_MCM-4
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSYHPRSEVLLADGQRIDIGTFVDSRIEKNNANVIDGINCEILPVDDIDVYTVDTDTGSASTVSIDRVSRHPAPSEFIRVKFSNGRSVLVTPEHPMFIDDGSETKTVQANALSGGEFVPAPHHLPGVNTDASSVSDDINDVSTIRTHVRSRARAKAEVEVRATDGEFKLIDAAQTLGIITAVGKVSVDAPERGIIVDMDRTVDSSKDSINNVLGSVIPSNDNDSITRVQDTGSTGNQWRWSVNTFIERMIEIAPAVTADRPNRRVPDAVLGGSEAVVQQFLTGVIIAAGRILDETIRIYASSNELACDYADAFLRLGITASVEDGPAEIAAQTVIKCDSDYERACGMFDISSSRTTPSDTSSQNNQSSVTAQNEDTHQTTSHEILPSGIADELQSIRQLLNIPASEQLASITAGDDGIALSIARAEINLLRDHIETLRMDTENVSIGRDDCVTPTISSSSKYKYAKNSITSDENLQLFGQSQAQLSERTKTTESSSISASTDLVSIPANISENRLVAATQRLDEVETRCNRRYHRVIAVDTVSNAGPHACEWVYDITVEPTNTFISSGVVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 172 - protein, 712 aa, Artificial Sequence
  Synthetic construct intein-modified proSavinase_S135:Hwa_PolB-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFTPDTNVLTPNGVRNIRDLTVGDSVYSLNPETMQMEIKPVTQTHEYPDYQGDLIDIQTNEIDFRVTPNHRMLVEATGTDTTSTNDYDFIEAGNLDISSRYELPHGWSVDHTDSLGAYIDLITLLREQSDTYNVLSDGGMTTAATADINHNNVTRRVDSDTFVSLIGWYVATGRVSRTQNGSDRVYLQLSQTNTKARTQLTMLLDELGVDWQADNEKIHFVSHVWTELFDTTCGRTEKNKHIPELIFDASASQKRAFFDAIINGSGVKNDDSYQYHTSSEDLRDDILRLCVHIGIVARYDYINDESWRIECTETANPDFTLTHSGRQSTAEDGVYCVTVADNQTLLAGRNGTFQWTGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 173 - protein, 883 aa, Artificial Sequence
  Synthetic construct intein-modified proSavinase_S135:Hwa_Pol-II-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFHPETKIWFRDTDNEWHHETIQTFVEDRLDDPEIDAVGTLVQEVDDNTDREISVPSIDDNGNERLQSVTAVSKHRAPNHLVQIETISGREITITPDHEMHIFEQGNLVSKQASKITSGEYAVIPKRLQTISPSSHTPQHDLLREFLTRDELTADRLIIHTSDPVRLCNRVFPEEVTSCKDAVEIMQNTACHLDKNKETLIGWLGEGRIPVALLRGFVETDEALLMSIPDDVQIGLRGEKVRIDRHIGFTEELTSLLGYYAAAGIVHTQTNPISYESAQQEQSRITFYNIDTQTQTDLLNALNSVFEIEPIQYNLDGEILGVPGELIRRVFDTVFDVGTQPSHKRIPQALFDASESHITSYLRCFFSTHDSLTTDTRDISATTVSREFKEDIIAALRRLGITAEVTTQQSRSVPEVLPDWYAIDDITHHDADNSLNLTRSYVISIASSDAVTLQRDRQAQEQIKYDAQGLIANNNAIHQSRQVTDGGRKDYITEPITDIEYVDADIDYTYCLTVSETHSLIVNDLSQKQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 174 - protein, 898 aa, Artificial Sequence
  Synthetic construct intein-modified proSavinase_S135:Hwa_Pol-II-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSVAADSRLVAVSPDDKIVFTTIEDFWKKLNTPIERNGKFRKRTCVSEGWQTYAFDENHEASLRPIEKAIRYTADESEQLRRITTQLGRSLDITDEHSLFRYDDGIEEVAGDDLTAGDIIVAPRTLDVEVTQTTLDLSEYIHDNERCPSEQTGSGELNLASKSAISDSRNKETPGVTHNILPQRSKFTDEMTTLSPTAVGGLESEQNETLRVGESTGAIERYINVDDSFGWLLGQFIAQRSISTDALTMTVHTAAEKHAERIVATSDSVFGIKPTVNSIERGYEIVFPSVFDTIVSGLTAKEQSEPEQDVDHTHTDEIGIPECILHAPDDIVLSFLQGFILAENAQRKGNAASEASEMVSESETTVTLETPSVGVKDGLVFLCHRLGVITDISEKSGEEYSVHFEESRYTVSIATEGKTNPLDQILNGERPTMPEGVSVPVPDALLTIHESIANSPHIDQVIPDTVVQQETVSLETLQSLLTGLSTVDLPAQLEAKRDELTLLTEGDLSYLRVESVECVDYDGYLYDLQVGGEPVFTANWLYAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 175 - protein, 762 aa, Artificial Sequence
  Synthetic construct intein-modified proSavinase_S135:Hwa_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTADSTVMLKEKGMVSVSEVETGDQIAQRSDTGFQYKPVEETHAYENAETLTVTLTNGCSIRGTPNHRLMVDDEWTRIDEIQPDQEVHYTLGWLRETNQSPPKLHSQSHTTVNQTADSISPDSSEPIELSESENADTGNRHNSAVAVKQSRTQTQLISDEVVSRPEHTRRPDQLSEELAELLGLWIDTGLWHQSGVQFNVERENIAEYIDQLSQQLFDTPAAISDTDGTYTVDITDHKLKEWWKANFGGKPDGTQSSYVPQMIKEAPTNVIEAFLRGCFTAEGGLRKDMRPRLCTSSEDSIDDIAVLMMGLGYPVEKSVIRNADGEPYYSVMPATDDGLSAFLHDVGFIDERREIGLSNIESSDSRALNNTHKIEVESIVESPPATVYDITVADNHEYVTDGIISHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 176 - protein, 792 aa, Artificial Sequence
  Synthetic construct intein-modified proSavinase_S135:Hwa_RIR1-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVEENSLVSTDEGLRPIKDLDNTTAEFEQWDEIDVGVTTDGGTKTATAVYDNGFANVRQIQTESGFNIAATPNHRFRTLSSDGTYTWKEAGKFESGDRVILQRNTFDAGSRVSLEANERADDAQDTTEGPELPGRMTSELAEFLGYFMGSGYISDETHASVDLVVDSDATELNSYLSNLGEQLFRITPAVESQEMSQVLSFRDCHLSRYFEDNGWKKTDTGHNGDASAAFVPEQILEGDEQVVNGFLRGVFEAIGTVSEKIEILTTSTTLADQLQSLLLSLGHVFTRDSTKLVETNNYHDDQLRQRLCGATRREDERFMNEIGSLIEPDELNLSTRADKNDTYPSSVIDHVQTLDGYDSVSESLKSRINQSQVDGTVSRKLIKDIEAETAETVSIADHELTGFYAATVESVTEDTAYTKDISVPSNNTYIADGFVTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 177 - protein, 568 aa, Artificial Sequence
  Synthetic construct intein-modified proSavinase_S135:Hwa_rPol_App
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSIEADESIVIRRDGETELTEIGSFVDTILAADNQETRITDGHEIALAPNGLEVPSLDTDEQIRWKHIEAVSRHASPDEILLIELESGRSIRATKAHSFVTRRDGDVLPVAGETLVVGDVLPTVGSYDHASGSISVPLQSQSVAADGGTVEPNTNITANAERDSASITSAGIIGSATWERISSIETVAPEYEYVYDLSVSGLETFTTGEGVVTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 178 - protein, 782 aa, Artificial Sequence
  Synthetic construct intein-modified proSavinase_S135:Kra_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTAGTRVLRADTGAETTMGELFALQARDVPVWSLDESLRYVRRHLTRVFPTGVKPVFRLRTASGKTVRATANHPFLTYDGWKPLGELSVADRLAVPRHVPAPERVASWTDDQVLLLGHLIGDGSFVKRQPLRYASVDEANLSAVTEAAANAFSIVAVRDEYAAARCTTLRLPAPYRLTHGRRNPLAAWLDELGLFGLRSYEKFVPQEVFHLPKRQIALFLRHLWATDGSVTLTRQSRGGRIYYASTSLQLIQDVSRLLLRFGISTRVRTTTPKGDHRPGYTLDVSGVDDQRRFLQEIGVHGARGATADRLLEVIRDVSANTNVDTVPRQVWDDVRRLLVEKEMTHREFAAAMGTSFGGSSLWKHAPSRERLGRVAQVLDSAELDVLAVNDVLWDEVVAIEPDGEEQVYDATVLGGHNFVADGIAVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 179 - protein, 734 aa, Artificial Sequence
  Synthetic construct intein-modified proSavinase_S135:Mca_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTADTWVMTASGARQVRDLIDRPFEAVVDGECHPTESRGFFFTGDKPVLRLSTAEGHTLRLTANHPVLRVSKMTRQLRETEWVKAGELRPHDKIVLHDHRALPSWDGAHTEAEGYLIGLLIGGGTLTRDKAILSIWDAAAPKVANGGGSVPAAGVAGVMRAAELAARTLPHRTDFNGWQTTMEGRGEYHMATGALHTLALELGLTPGDKRLTAPLETTSSAFHRGLLRGMFDADGSVQGSQRKGVSIRLPQTDLGNLQTVQRMLLRLGVASTIHQNRRPGGTKVLPDGEGGAKGHSCQAAHELIISGENVVRYAERIGFADSDKMDRLTALLQRYRHTRHAERFIATVQSLEDDGMEAVYDVTVADVHAFDANGLYVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 180 - protein, 519 aa, Artificial Sequence
  Synthetic construct intein-modified proSavinase_S135:Memar_Pol-II
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAGDTEITVSDGRRWMSLPIRQFVTENFDISKPGLDHVGTFYSDPRQPFYVRSIDSQGKTSLKRVTSVSVHRAPAHLVRFATRRGRVLTVTPDHAMLVWDTDYLRKIKALEVAVGDRVPVEEGGLVVADEVVSRETVQALDDRVYCLTVAENHTLVANGIFCGQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 181 - protein, 624 aa, Artificial Sequence
  Synthetic construct intein-modified proSavinase_S135:Mex_helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAAGTLIKTPKGPVPIEQIQSGDLVFNAIGIGVVEGIVCQQKQTITLELSDGTSIVCTHDHPFFCPRGWVAAGDLEVGSGLFSHEDLRRLWSGGASLGLESGSSDGRGAVRSSEVLLRILREEAREPDAGYCGPAEDVRNASTDRAHAEGAWWQWQADPIASDEAARSAGRRVADRVRDEDRREARPEPTAVLLQDRHCEPLANDRNRSGREHSSRGTGEAEGQRQGDVPCSVRVVSISREERGGPEAVYNLRVSGHPSYFAGGVLVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 182 - protein, 519 aa, Artificial Sequence
  Synthetic construct intein-modified proSavinase_S135:Mhu_Pol-II
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFHGDTLIEIYADGILEEIPIRRFVLEHLDLSQAGVDALGTFYADPVRPAHVRSVDTGGIPHLRKITSVSVHKAPANLIQFSTSRGKNLLVTPDHAMLVWDVSYLRKIRALEVKIGDAVPVWESGVVISDRIVSIDYVPCEDERVYCLTVDRDHNVVGNGIFTGQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 183 - protein, 853 aa, Artificial Sequence
  Synthetic construct intein-modified proSavinase_S135:Mja_GF-6P
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 184 - protein, 855 aa, Artificial Sequence
  Synthetic construct intein-modified proSavinase_S135:Mja_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLNANTEILQESGFRKITELNKDEKVFALCGKEIKPVDGWKVHKTPQHEYNIVVKTVNGLEITTTPNHIFLVKENGSLKEKEAKDLKVGDYVATVDRIRVKEKDIDLSNGDLYFIGYFIGDGYTGVIEKNTLKATPDLAFNPKYPPNFDDSELHKKYFLKCRISKGVAHYIYSKKLRKIFNKLNMLTKDNKNIDAFCNLPLDKLAYLIAGLFDSDGYIYLNRKNIEFYSISEKLVEQLQFVLLRFGIHSSIRKKKTKTMVSPTNGKEYKCKDIYVLTIRDFMSIKRFYENIPLRHEEKRRKLEEIIKNKEIGQIPSEFVALRFTPIAKIWCDCGFSVDLTMFKPRTKRQRELNKKRVKLLFELLDGKKLITNYKEYYSKRKNPYFDFIVREKINGNNYYSLNEKGRVLMSLLNKHIKDKENLEEMYNFLVNLEKCPICGKPIHKEMRYSWKKECYDGDIYWDRIKEIKKIKVNDKYAYDIELPDDGSNSHYIVANGFIVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 185 - protein, 746 aa, Artificial Sequence
  Synthetic construct intein-modified proSavinase_S135:Mja_Hyp-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVPPDTLLILENGFKRIVDIKVGDKVLTHENRFKKVEKVYKRRYIGDIIKIKVRYFPEEIILTPEHPVYAIKTEKRCDGSHGICKFNCLTQYTNPSCKKRYRKYKREWIIAKDLKVGDVIVYPIPNRVRDIKYLSLDKYLSNIKREFCRSRIPEKIEVSEEFCRLVGYFLSEGYCFRDGIGFALGENEKKIIDDIEYLMKKIFNLKPKIRDDGRSEGIELKYYSRVLRDFFGDMFYCGDEKRAWNKALPNEFLYLPKNKQLQIFIGWWRGDKGVTTSEILMNQLRLISLRLGFIITFSKHVPKNPKIGDREVIKYHARWQGRVSILDEKIVDELKNEDIKLPKKDVRYGWIKGNYLYAPIIRIGREYYDGFVYNLEVEDDSSYVTVSGTLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 186 - protein, 900 aa, Artificial Sequence
  Synthetic construct intein-modified proSavinase_S135:Mja_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLMPHEKVLTEYGEIKIEDLFKIGKEIVEKDELKEIRKLNIKVHTLNENGEIKIINAPYVWKLKHKGKMIKVKLKNWHSITTTPEHPFLTNNGWIKAENIKKGMYVAIPRKIYGNEDFEKFIEFINSKILTNELIVKVNEKDLKNVELPSTKIYKKQKNVFRSEDIIEHNLNIEKISFSPRIHRCGKPQHYIKLPKSLNEWKAIFYFAGVMFGDGCVDRIANNDEEVFNKLKSLNNLGIEVERIKRKSSYEIIFKNGKNALINLLKILFDYPSEKKSHNIKIPQILYIAPKELVAEFIKGYFDADGYVNLRQNRIEVISASKEFIEGLSILLLRFEITSKIYEIKKSYKETKKKYYQLNIVGKRNLKNFKNIGFSIKYKEENLNKIIEKSRKSEKYPINKDMKRLRILFGMTRNEVNVSYYAKYENGKEIPSYEIVKKFLNSLKPKNLDKKIKVLEGKERDVNYLKAFESDGLIENGRLTKLGREALNIWKNHEFGKENIDYMKSLIENIAFVEVEDVEIIDYDGYVYDLTTETHNFIANGIVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 187 - protein, 522 aa, Artificial Sequence
  Synthetic construct intein-modified proSavinase_S135:Mja_Klba
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGALAYDEPIYLSDGNIINIGEFVDKFFKKYKNSIKKEDNGFGWIDIGNENIYIKSFNKLSLIIEDKRILRVWRKKYSGKLIKITTKNRREITLTHDHPVYISKTGEVLEINAEMVKVGDYIYIPKNNTINLDEVIKVETVDYNGHIYDLTVEDNHTYIAGKNEGFAVSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 188 - protein, 766 aa, Artificial Sequence
  Synthetic construct intein-modified proSavinase_S135:Mja_PEP
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 189 - protein, 723 aa, Artificial Sequence
  Synthetic construct intein-modified proSavinase_S135:Mja_Pol-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 190 - protein, 830 aa, Artificial Sequence
  Synthetic construct intein-modified proSavinase_S135:Mja_Pol-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 191 - protein, 902 aa, Artificial Sequence
  Synthetic construct intein-modified proSavinase_S135:Mja_RFC-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 192 - protein, 790 aa, Artificial Sequence
  Synthetic construct intein-modified proSavinase_S135:Mja_RFC-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 193 - protein, 897 aa, Artificial Sequence
  Synthetic construct intein-modified proSavinase_S135:Mja_RFC-3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 194 - protein, 848 aa, Artificial Sequence
  Synthetic construct intein-modified proSavinase_S135:Mja_r-Gyr
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTPDTYVVLGDGRIETIEDIVNAKERNVLSLDLDNLSIKIDTAIKFWKLRYNGNLSKITLSNNYELKATPDHCLLVLRDNQLKWIPAKDIKENDYIAMPFNYKVERKPISLLNLLKYLDITDVLIEFDENSTIFEKIAEYIRNNIKTSTKYKYLRNRRVPLKYLIEWNFDLDEIEKEAKYIYKSVAGTKKIPLFKLDERFWYFAGLVLGDGSIQDSKIRIAQTPLKDVKSILDETFPFLHNWISGNQVIISNPIIAEILEKLGMRNGKLNGIIFSLPESYINALIAGYFDTDGCFSLLYDKKAKKHNLRMVLTSKRRDVLEKIGIYLNSIGILNTLHKSREVYSLIISNKSLETFKEKIAKYLKIRKEAFINGYKTYKKEHEERFECDLLPVKEVFKKLTFEKGRKEILKDSKIHIENWYKEKTNNIPREKLKTVLRYANNSEHKEFLEKIVNGDISFVRVKKVENIPYDGYVYDLSIKHNQNFISNGVISHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 195 - protein, 807 aa, Artificial Sequence
  Synthetic construct intein-modified proSavinase_S135:Mja_RNR-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSLGRDELIFIKEGDKLKVCKIGEAIDEFMEKYKDKIIVDGDTEILYLDGIAEVYTISVNVKTGKAEFKRVYAISRHKPRGKVYKVIGKDGTSIIVTEDHSLFNYDENGNLVCVKPRQMKHIIRNFNNPYDVEYRIGDYIETNYQRTDSKYNSRQNDIPEKLKITKELCQFLGLFVAEGSYITNGISITTKDDDIAKFIERFVKEQINENIAVKRYEDSVRFVNKGFYRFLKEHINGKAINKNSPEFILKGDKEMKLAFLGGLISGDGYVSKDGRVQIYTTSEQLLGQLHLLLSDLGMIYSITKIKEEGEKIEIKRNEIVRNYKLYVIEIAKNCTEDLKPYVIPKYKKERIKPANYDQLPYDYRIIKEHLRKITDKKPYNDYAWKSNNRKLKLNTLEKIEQLNPHLREEINKFKLNIPFEIKEIKEIDYNGYVYDLSVEDNENFITATGILCHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 196 - protein, 887 aa, Artificial Sequence
  Synthetic construct intein-modified proSavinase_S135:Mja_RNR-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSLPYDEKILIFENNEYKLVKIGEFVEKYLNRYKDRAITYGDNNIEVYIKDENIYAPSFDKDGKIVLKPITHAIRHRGKEIYEIELESGKKVRVTGDHSVFTINDNLDVVEVKASDLKVGDFIITPKIIPSISKDKIYLSEIVKNKDKYYVKIKDHIKFIEEHEEILKESYKEYKTKWKDLKPVLKKKNAFRLDLIEDLVDKEKIEKISYGHANYINNKIKLDEKFGYLIGAFLSEGHWNDKCVEISSTNKEFIENLVEIIEEILGKDAYYITVKGDKRRYKDLYVIGLNKTVAMIFESLGLNKLSSNKEIPSILLSNETFLKGLIKGYIDGDGSIYVDESKRDYSIRLYTTSETLRDTLCLALKILGINYRLSIDKKSKVNENWRDCYVIKITGKENIEKLLDVEIKNNGGKDVIPKIAEKFKEIINQYSQREWKERFGIDVNNLHIWEDLKKGYMSRYRAKKVLNIMKNVKEIEEKYGRLLDKIGQLIDNDLLFERIKSIRVLDEIPEYVYDISVEGTENFIGGEGFICLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 197 - protein, 806 aa, Artificial Sequence
  Synthetic construct intein-modified proSavinase_S135:Mja_rPol_Ap
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVDGDTTVLLDGKLIKIKDLEDKWKDVKVLTSDDLNPKLTSLSKYWKLNADEYGKKIYKIKTELGREIIATEDHPFYTTNGRKRCGELKVGDEVIIYPNDFPMFEDDNRVIVDEEKIKKVINNIGGTYKNKIINELKDRKLIPLTYNDQKASILARIVGHVMGDGSLIINNKNSRVVFRGDIEDLKTIKEDLKELGYDGEEIKLHEGETEITDYNGKKRIIKGKGYSFEVRKKSLCILLKALGCVGGDKTKKMYGIPNWIKTAPKYIKKEFLSAYFGSELTTPKIRNHGTSFKELSFKIAKIEEIFDEDRFIKDIKEMLKEFGIELKVRVEEGNLRKDGYKTKVYVASIYNHKEFFGRIGYTYANKKETLARYAYEYLLTKEKYLKDRNIKKLENNTKFITFDKFIKEKCLKNGFVKEKIVSIEETKVDYVYDITTISETHNFIANGFLTGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 198 - protein, 825 aa, Artificial Sequence
  Synthetic construct intein-modified proSavinase_S135:Mja_rPol_App
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSLPYEEKIIIKEGEFIKPVEIGKLVDEMIERFGFEKIGNSEVCDLPIDIYALSLDQDEKVHWKRIISCIRHKHNGKLIKIKTKSGREITATPYHSFVIRKDNKIIPVKGSELKIGDRIPVVKHIPANCVEAINISDYVSGNYVVDNINNKIAPKINGKSIPNNIKLDYDFGYFIGIYLAEGSVTKYFVSISNVDELILNKIRAFADKLGLNYGEYDNNNGFAESHDIRIYSSTLAEFLSNFGTSSNTKKIAEFVFGANKEFVRGLIRGYFDGDGNVNADRKVIRVTSNSKELIDGIAILLARFNIFSIKTKTKNQFVLIIPHRYAKKFHEEINFSVEKKKSELERLVSSLNDDKTYDSIDMIPSIGDALTKLGEKVDYPKVILKKFERKQKIGRATLQRHLRRIEELAVKKGVNILALKEYWLLKKAVESDVIWDEIVKIEEISCDKKYVYDISVEGLETFTTFDGVLTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 199 - protein, 842 aa, Artificial Sequence
  Synthetic construct intein-modified proSavinase_S135:Mja_RtcB_Mja_Hyp-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTSNSKILTDDGYYIKLEKLKEKLDLHIKIYNTEEGEKSSNILFVSERYADEKIIRIKTESGRVLEGSKDHPVLTLNGYVPMGMLKEGDDVIVYPYEGVEYEEPSDEIILDEDDFAEYDKQIIKYLKDRGLLPLRMDNKNIGIIARLLGFAFGDGSIVKENGDRERLYVAFYGKRETLIKIREDLEKLGIKASRIYSRKREVEIRNAYGDEYTSLCEDNSIKITSKAFALFMHKLGMPIGKKTEQIYKIPEWIKKAPKWVKRNFLAGLFGADGSRAVFKNYTPLPINLTMSKSEELKENILEFLNEIKLLLAEFDIESMIYEIKSLDGRVSYRLAIVGEESIKNFLGRINYEYSGEKKVIGLLAYEYLRRKDIAKEIRKKCIKRAKELYKKGVTVSEMLKMDEFRNEFISKRLIERAVYENLDEDDVRISTKFPKFEEFIEKYGVIGGFVIDKIKEIEEISYDSKLYDVGIVSKEHNFIANSIVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 200 - protein, 689 aa, Artificial Sequence
  Synthetic construct intein-modified proSavinase_S135:Mja_TFIIB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSVDYNEPIIIKENGEIKVVKIGELIDKIIENSENIRREGILEIAKCKGIEVIAFNSNYKFKFMPVSEVSRHPVSEMFEIVVEGNKKVRVTRSHSVFTIRDNEVVPIRVDELKVGDILVLAKELPNIEEDIEIDKKFSKILGYIIAEGYYDDKKIVLSYDYNEKEFINETIDYFKSLNSDITIYSKDLNIQIEVKNKKIINLLKKLRVKNKRIPSIIFKSPYEIKKSFIDGIFNGKDAKVFVSKELAEDVIFLLLQIKENATINKKSINDIEVYEVRRITNIYTNRKLEKLINSDFIFLKIKEINKVEPTSGYAYDLTVPNAENFVAGFGGFVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 201 - protein, 808 aa, Artificial Sequence
  Synthetic construct intein-modified proSavinase_S135:Mja_UDP_GD
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFHPDEVLFIDRGRGLECITFKELFELEDKDNVKILSFDGEKLSLKKLKLASKRYYNDDLITLRFNLGREIKITKDHPVVILEDGELKIKLTSDVKEGDKVILPYGNFGEEREIEIDILEELSKTDLIEKVWIHNKDLATNEFNIIKPYLSNKYPHDVKRNGTIRAKDILPIKEILDKYGSKNRLFTAKSKSTTIPYKIKIDKDFARLIGYYLSEGWISKDYGRNGVVRKRIGLCFGIHEEEYINDVKNILNKLGIKYIEKIKDGSHSILISSKILAYVFENILNCGINCYNKNIPPQMFNAKEEIKWEFLKGLFRGDGGIVRLNNNKNLNIEFATVSKKMAHSLLILLQLLGIVASVKKCYNNKSTTMAYIIRINGLEQVKKIGELFGKKWENYKDIAESYKRNIEPLGYKKSDNFAILEVKEIIKEHYSGYVYSVETENSLLITSYGILIHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 202 - protein, 748 aa, Artificial Sequence
  Synthetic construct intein-modified proSavinase_S135:Mka_CDC48
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 203 - protein, 876 aa, Artificial Sequence
  Synthetic construct intein-modified proSavinase_S135:Mka_EF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVAPETKICLADGRFVRADELFEELKERGRLVKCDESEEVYELREPVGVSSLDKDAVEIVEGKITHVWRLKADKLVEVEVKNGRSIRTTPEHKFLVLDPSGEIVEKRADELEIGDYIVCTQKLVHEGMSEEELKREVFRRLGRDFFVHLPEEEAESVLELAKERGIKALWETLEVDIEENSFYYQLRKGRIRADILVDLAEELGLDLADLYDAVEVSYRSNTKSTKPIRLPEPEDLFYLAGLMFGDGCWNQLTNGSEAIQGEVKRIASDMGLEVRVRRYEGKTARIDFPETVPRILEALFDYPRRKKAHRIRVNDFLTRAPLDCIAEFIRGYFDADGTVEEGRSAVSVTSVSREFLEDLQLLLQKFDVASYLREGDGAYTLYVSGARSLERFPGFREPEKAEKLKKLMEKASSSELEKVPISGEILREVRGDVPTTRMFNCYSNYEGGQVGLTKSSLEKVISTLEAVGVEGEALERLKALARDDVCFLEVVRVEEVEYDGYVYDFTVEEHHNFAAEGFVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 204 - protein, 659 aa, Artificial Sequence
  Synthetic construct intein-modified proSavinase_S135:Mka_RFC
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSVSADTPILVRRGGEVLRVTFEDLDSWYFGDRGGEYVDVSDLEVLTVDRNFRVTWARVSKLIRHRARKILRVHLEDGTIELTGNHAVMVLDEGGLRAVKASEIEEGSFLLSFVAELDEQPTDGGTVVTSVGSGSRVSDTTYELPVEVRVELLRELADDGVIEASEDVSVDLAWLARISGVESRVTDDGVELVWETRTGDLLPADPVLKLVERLESDLVDDLESWVFDGRVSKEAVRKVLSSVDAKNLRGDARRAYRMLRTLVRSDVHAVKVEDLDVMDYDGYVYDVSVPGNEMFFAGEVPVLLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 205 - protein, 836 aa, Artificial Sequence
  Synthetic construct intein-modified proSavinase_S135:Mka_RtcB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAPGTKILTEHGCWVKVEDLPKMLTDQKLKVYDVDEGREDDSEIKFVMERGIEEDERAVVLVTESGLTIEGSEDHPVLTPEGYVELGEIEEGDLVVVYPFEGVEYEEKEGTILDESDFEDVDPQVLRYLEERDLIPLRWSDPKVGTLARILGFAMGDGHLGEQAGRLTLSFYGDERTLRELKRDLESLGVKANLHVRKRRYEIETASGRYEGEATSVELRVASRSFALLMEKLGMPRGRKVETPYKVPDWIKEAPLWVKRNFLAGLFAADGSVVKFKRYTPLPINLTQAKVEELEENLREFMNDVAKLLREFGIETTLYEVKSKKNVVYKLAIVGEENIKRFLGKVGYEYDPEKKVEGLAAYAYLKLKERVKKDRKEAAETAAEVYEETGSITKAHEAVADVVNRRFVERVVYDGGISSVRVPEDFPTFERFKEERVLAGGFVIEEVVEVKGVEPEYDRFYDIGVCHGAHNFIADGVVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 206 - protein, 871 aa, Artificial Sequence
  Synthetic construct intein-modified proSavinase_S135:Mka_VatB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAPGTRVITASGDVVEIDEIVERAAETAVDGGLREGSTEVTVGVTNVRTLAAWDGDLTSNDVVAVEKIEAPSRAVRVRTRSGAELVVSEDHKFLVDTEDGPRMVEASELKSGDELYSVRELRVSEKVPTYLELLLEAEDKFYVHPTEEFEEAVAERYGSLAEACREKELPYRAREAKERRYYELSEFARLATAVIESVDEATEYIDYVTAGGRKRVKFSSPRPGKEVMYVAGLIASDGSVDTERGFVMFSNTERELLSAFEEIVTEEFGVDASKTENQNGVTMLRVNSRVLARVFERLADPKTVLKMPRELVAAYLAGYVDGDGHLKDGKIVITTADRERAGDLQLLLKRLGVPSVLRERDGAYDVVVTGHDAAELAEELPLRHPKKAEAAASMSSGRRSSRFDRVSRRFGRLLREVRRKYGVRASDLGSSSTISQIESGERRATRRLALEIVERLEEVVGDVEEVRELRELAEGNYVLDEVVEVETVEYEHEYLYDVTVVPDHTLVVENGIITSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 207 - protein, 671 aa, Artificial Sequence
  Synthetic construct intein-modified proSavinase_S135:MP-Be_gp51
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCSWTNARAVTRRGFVHVDDLTTDDEVMSVDDQGRTIWQQIDEVVRFPFSGTLYSLGGREINATITANHRVVGLNREKTKWVEHTPTSLPGNKMWVYTAGEGSNEDYPLTDTEIRLAVWGLTDSHRSPDGRWTFYQSGEKAEQVRKLLADAGIEYRERARNRGITEIDGKVLKAPPKTQYEFSLGKVQELDDLLDRGRSELPTWTLSLSQRQARLFLEEYRFTDGTDTTSAGDSYVLYVCKDRMREQLQMLAAANGLRASTTEYRPGHWRLNISNRALSGLYKNTVEEVAYEGEVWCLRVPNGRFFIEDGGKIHLTGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 208 - protein, 684 aa, Artificial Sequence
  Synthetic construct intein-modified proSavinase_S135:MP-Catera_gp206
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSLACSTPILTTNGWSTMGALQDGDEVYAPDGQPTKVIKAHPINLNRPCFKVRFRDGQEVVTDAEHLWQVNDRNNGGRDRVMTTQEIADAPWGGRYRFRVPVTEPLQTPEADLPVDPWLLGAWLGDGDASMVSICSGSQDLDYLISRVEGLGLSHRVNRYGSRAASVYVHGMRAVFSELGLLKNKHIPDRYLTASVAQRRQLLAGLMDSDGTVSDRQVTISMKNERLMRQVLQLVRSLGYRAGFGSRMARLNGRDCGLVYVVRFHTGWGESPFDMPRKRDGWEQATKTSVQNLRLNAIVAVEPVETVPVRCITVAHESSLYVAGEGFVPTHSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 209 - protein, 790 aa, Artificial Sequence
  Synthetic construct intein-modified proSavinase_S135:Mxa_RAD25
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVKNDSLIFTDRGLVTAAELAVGVPEEHAAFTEVGVDTSTGRATTNAVYNGGRSPTKRARLALGYELEATPEHPIRVLRDDALAWVRMDELHVGDRVALRRGSEVWGRSSLPEAFRWVKPKYAANLKLPKGLVLDEVAAEACGLLVSEGTLTKRLVTEFTNADADNVGFISRWAASIGIDLSRNGSDSIQYLLCSVVLREWLAWLGLDYTRAAGKCIPRAVRFGGRDIMRAFLRGLFDGDASVDPLKGVIEFCTASERMAREVQVALLGLGILASRHSRTVAGYEQLYWRVTVNDVATFEREVGFSSNWNRLRLREAVARAEGRCRNPNVDTVPINGLVERLYRTAQKQLSWSSQEGRIFGNYVHGEHAPSRAALERMVQRWGSECPTECLPIEAFLELPVAFLSVESIEDGEADVVDLSVPETHEFVANGVVCHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 210 - protein, 779 aa, Artificial Sequence
  Synthetic construct intein-modified proSavinase_S135:Nfa_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLPASTRILRADTGAESTLGELLASGEQPLVWSLDERMRMVARPMVKVFPSGRKEVFRLRLASGREVEATGNHPFLTVDGWIPLDRLTVGDRLATPRSVPEPVHTERMADAEVVLLAHMIGDGSCVRRQPVRYASIDEQNLAAVSEAAEHFGVTAVRDDYAAARVTTLRLPAPYRLSRGKRNPIAAWLDELGLFGLRSHEKFIPRRVFALPNDQVALFLRHLWATDGSVRWDSTYRQARVYYTSTSRRLIDDVAQLLLRLGVHGRIRRVTKPGYRDAWHLTIDGADNQTVFLRDVGVHGARGDAAQVALAELEPLVRNTNVDTVPNEVWNQVRHLLATKNITHREFSAAMGSRFCGSTMWKRSPSRSRLARVAAVLDDADIEMYATNDVFWDKIVEITSLGEQDVYDGTVPGTHNFVAQSISVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 211 - protein, 667 aa, Artificial Sequence
  Synthetic construct intein-modified proSavinase_S135:Nfa_Nfa15250
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFPAGTVVSGPSAEAATRRWFEGELVVFTTASGKQLSLTGNHPVLTRGGWVPANLLNEGDEVVRSTRPQGATPLVVPDHHQVPALIEDVWGSFAVNGLHRVPAAPEDFHGDGQRGEVDIVGPDRTLWCGHDAAIAQQREQQFFTRRTESSGLLVAESVAQLVDLWQAPHSGSSIGRSGLPFALIGGHGGGPVERGLTVAAGGYPGLHEALADYRPGDAVLPPQGVFAGSSEIGGDDCVIGKVDSTRWDAPALPFLVEGRAGYASRGKELFDRLTGQVELDRIVILRRVQWSGHVFSLTSSEGWHTGNSLIVSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 212 - protein, 763 aa, Artificial Sequence
  Synthetic construct intein-modified proSavinase_S135:Nfa_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFPAGTPVDTIDGPKPIESLRAGDRVLSHDGSYATVEKLIENTNDQPLVSISHFGHKEPIRCTPEHPILVWTDRDVETLIDGDGADPFNGFVWLAAQDVHPSDFIVATAPLETRERRVFDLMNHVGEGTYEEVDGLIRKVNTDARHRNKQRHRQGFVAVTRYVEESYDLGLILGWYLAEGHVSKRSGVEDVRPTGVHFTLGANEIERHVELGMAFKQVFGVDLVLHTNHSDHSTRMVCNSKIVASLLLSLAGTGYSTKRLAHEVMTADEDFQRGLLVGLFRGDGCTTTGGMVLDLVNQELIDQVQLLLRRLGIVSVVRTYTNQAGNPTGQVFVPGLPGTNEEFIFDVDKNLQNYTGRKGTKRTTYQVVHGRHVYGIRAVERTGETPRQVYNLHVEGTHTYTIRGAVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 213 - protein, 693 aa, Artificial Sequence
  Synthetic construct intein-modified proSavinase_S135:Nph_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVDGDTSVTLASGDEKPIRDIVESTLEDPTEISDGFYQESDIDVLTTDGGAVAPGRATKVWKRQAPEKMYRIRTESGRELEVTPSHPLFVQSEGGLSPLVADDLSENDFVAVPRALPADDGDDFGQHVDDLGSVTARKTADAEAVRSEDAATTPDVIPNVGDQLRRIRTSLRLSQHDCGLPRSTYQQYERGDRNPSRSRLQTVLTAFERRIEQLSSLSDRVDDGDSDAIAAARDELNPSQASLASGMDATRTAIGDDERTEARPDGGAVADAERAVADALCRALAVADDVERLRSLADGDIGWDRIDSIEPVEPEDEWVYDLEVESTHSYLSNDVVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 214 - protein, 846 aa, Artificial Sequence
  Synthetic construct intein-modified proSavinase_S135:Nph_rPol_App
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSIPADEQVVVRRNGETELTEIGPLVDSLMDSRETRSFDDHEVTLAPDGIEVPSLSSEETVEWKPIEEVSRHETPDELLRFELESGRSIRATKAHSFVTRQENEVVPVAGEELEAGDWLPVVASLDATDTQETVDLRKYLPAGDYWYTSVLADGGAEAVPGGPDQLRNKRAALEAGELAEHTAYPVQGTVGLPEQFPLDEETGFFVGAWLAEGSLADHYVSISNVDAAFQSRIRSFAERFDLTVNEYENDSGFAAGYDIRLNGTILSDFLRAACTDDGEKSIPGFAIGANEAFLKGLLQGYFSGDGNVGTNAIRSSSTSDRLTAGVGLLLARFDVYATLGQQEDSRTLRVPKKHVSRFDNRIGMVGERGAELEALAESADSDGPDATDQIPNFGDALEAVAEAADIPQRQVNSATKRQRIDRSRLARLVAAAEAELDGEQSELDALRQAVTGDVVWDRIESIETVESDHEYVYDVSVEGLETFTTADGVVTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 215 - protein, 676 aa, Artificial Sequence
  Synthetic construct intein-modified proSavinase_S135:Npu_GyrB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFIGDTLIPLADGKSYRIKDLMDWGTEFIVYACTPTGKIVAAQATAKLTRRNAPLVKVILDNGEEIICTPDHQFMLRDGTYKEAQLLQAETSLMPFYSKTDKDGYTLITQPYSSRWQKAHWIIARSGLLGKVPRFEGQKTFIHHQNFDESDNRPENLEFMGNRDHSAYHRSLVERNQHWHSAEFEEKRVASLAQKAKTSEGYQYYAERGTRNIFQYMEQQPEHFKNAVAGNGNRGKQYLVEYNKTEKGRGKSQEIANRYYTCEICGVDVKTPIGLHNHRRKEHQCNHKVVAVNLLNYTEDVYCLTVPEYHNFALKAGVFVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 216 - protein, 706 aa, Artificial Sequence
  Synthetic construct intein-modified proSavinase_S135:Nsp-JS614_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGALALDTALPTPSGWTTMGDVQVGDQLYDAHGRPTTVVAATEVLTGRPCYEVEFSDGSRIVADAQHQWLTESRAARKSRWAADKQYNRARNQNIVASVVTTEAIAGTLRVGADQRANHAVLTADPLSGSDVDLPIPPYVLGAWLGDGHSASARITCETPEIPMYLEACGLRVDHQGAMLYSLKFPDGDPRGSVQGVLRTIGVLNDKHIPADYLRASEGQRRDLLAGLMDTDGTVVRGVGSCQFAVTNKRLADDVYELVVSLGYKCGRTTRRVQGRSPETSTCHILNFSTVDDVFRLERKHLLHKEERPVTRARIARRYITAVRPIESVPVRCVEVDNTEHLYLAGESMIPTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 217 - protein, 761 aa, Artificial Sequence
  Synthetic construct intein-modified proSavinase_S135:Nsp-PCC7120_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLPEDALVHTAKGLVPIRDVQVGDLVQTPLGFRRVVDKFDQGFQDVYEIETNATYPRATLNHRQAVLEDAKGGIVWKHIASLEAGDRLLHNKQVLPGTVTHLPADFTESRPSHSRTAKSFVVPELTAEVAWLIGFTHGDGYVALGRNKYDKPYGRVEWSMNSLDAEVTSRIQAKIDAALALFGLSAVHSITKGENTAKSICSSIRLAEYFHRHIKQPNIPLTVPSFILQGSVDIRAAYLAGLMDSDGAVNNRPPHLITSVYRSFIRQVSVVLSSLGIAGRLTTTYPQNSNWQVKYNLTIPALKERYNALISPHSAKGELRQGLKMYGFTVPGAVMRETYTYSEMREMGFQGSRTVDANYERYVAEADISLDIPVTVKGLGSYDHVQTYDIEVDEAHCFYCDGYLTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 218 - protein, 518 aa, Artificial Sequence
  Synthetic construct intein-modified proSavinase_S135:Pab_CDC21-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 219 - protein, 622 aa, Artificial Sequence
  Synthetic construct intein-modified proSavinase_S135:Pab_CDC21-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 220 - protein, 748 aa, Artificial Sequence
  Synthetic construct intein-modified proSavinase_S135:Pab_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLLPDEKVVVPSVGFVTLKELFETASKVVERDDEKEIRELDERITSVNGDGKTGLVKASYVWKVRHKGKVIRVKLKNWHGVTVTPEHPFLTTKGWKRADQLRPGDYVAVPRFIHGNEDEKIFLSYVKVKKSGEEWKEYFYLAGRKGNIDVNLLFVAPKRYVVEFLRGYFEERSEVKGESVIVEARELVEPLSLALLRFGIFSKIQGSKLIVTGKRNLEAFKDYIGFKDEREKALEEAIEKVKGSEVYPIFEEIRRLRLLFGFTREELGSYAKYENSEAPTYEELMEILDFIERGSPSLSKKIAILEGKLKAELRVLEEEGLIKDGKLTPLGRELLEVWRNREFDSKDVDYIRNIAETLVFIPVENVEEEEYDGYVYDLTTETHNFIANGILVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 221 - protein, 550 aa, Artificial Sequence
  Synthetic construct intein-modified proSavinase_S135:Pab_KlbA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGALYYFSEIQLPNGKEFIGKLVDELFEKYHDKIGKYKDMEYVELNEEDTFEVISIGPDLSARRHKVTHVWRRKVKDGEKLVKIRTASGKELVLTQDHPVFVLLGRDVARRDAGNVKVGDEIAVLNTRPDFSVLSPPAMPELLSEPFNYELSSIGDVAWDEVVEVDEIDAKGLGVEYLYDLTVDINHNYVANGIVVSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 222 - protein, 687 aa, Artificial Sequence
  Synthetic construct intein-modified proSavinase_S135:Pab_Lon
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFSGEETVVIRENGEVKVLRLKDFVEKALEKPSGEGLDGDVKVVYHDFRNENVEVLTKDGFTKLLYANKRIGKQKLRRVVNLEKDYWFALTPDHKVYTTDGLKEAGEITEKDELISVPITVFDCEDEDLKKIGLLPLTSDDERLRKIATLMGILFNGGSIDEGLGVLTLKSERSVIEKFVITLKELFGKFEYEIIKEENTILKTRDPRIIKFLVGLGAPIEGKDLKMPWWVKLKPSLFLAFLEGFRAHIVEQLVDDPNKNLPFFQELSWYLGLFGIKADIKVEEVGDKHKIIFDAGRLDVDKQFIETWEDVEVTYNLTTEKGNLLANGLFVKNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 223 - protein, 809 aa, Artificial Sequence
  Synthetic construct intein-modified proSavinase_S135:Pab_Moaa
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFPPTEEAVFKFGDKVKIATFEEVAKNFKFEHKVEIDGFKGEYSIPNDLYVLTFNDGKAEWTRVTKFLRRKHEGKIRVIKTKTGRTIRTTPEHKFFVYKDGELVKKRADELEPGDELVLLWRFESEETLTEINLLEAFKDLPQEEKEKVYVRGIKDLDLTPLKEKYGDKVYYWARQDSMPLSVFYELNVDLDKEFRLGRDATTYELPSKLKITPSLAKLIGYFVSDGNYSDKDLRITVGHEDVEKEIVNILEELGLPYSFLEWEGKTKQIVIGSRLLRLVFKHVFKIPEGAPNKRLPEGFLSFPFEAKVALLSGLFNGDGYVVRGEHHLSIGYASTSKGLIRDILYLLASLGIFARVYRVPKEKMKGANHDLYKLYIAGTDLVRLVELLELREGHREKLGEIGNRKPARVKKIADFYIDVVDEVSEEEYSGYVYDLEVENEGHSFVAADGILVSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 224 - protein, 539 aa, Artificial Sequence
  Synthetic construct intein-modified proSavinase_S135:Pab_Pol-II
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFPGDTRILVQIDGVPQKITLRELYELFEDERYENMVYVRKKPKREIKVYSIDLETGKVVLTDIEDVIKAPATDHLIRFELEDGRSFETTVDHPVLVYENGRFIEKRAFEVKEGDKVLVSELELVEQSSSSQDNPKNENLGSPEHDQLLEIKNIKYVRANDDFVFSLNAKKYHNVIINENIVTHQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 225 - protein, 853 aa, Artificial Sequence
  Synthetic construct intein-modified proSavinase_S135:Pab_RFC-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 226 - protein, 962 aa, Artificial Sequence
  Synthetic construct intein-modified proSavinase_S135:Pab_RFC-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 227 - protein, 753 aa, Artificial Sequence
  Synthetic construct intein-modified proSavinase_S135:Pab_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 228 - protein, 792 aa, Artificial Sequence
  Synthetic construct intein-modified proSavinase_S135:Pab_RIR1-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 229 - protein, 736 aa, Artificial Sequence
  Synthetic construct intein-modified proSavinase_S135:Pab_RIR1-3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 230 - protein, 790 aa, Artificial Sequence
  Synthetic construct intein-modified proSavinase_S135:Pab_RtcB_Pab_Hyp-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAPGSKVLTEHGYWLKVEELPEKFKLQGVKVYNLDEGHNDTSNVAFVAEREVETGEMAVRVTTESGRIIEGSEDHPVLTPEGYVYLGNLKEGNLVIVYPFEGVEYEERKGVILDEDAFKDEDPQVLSFLREKGLVPLRWDDPRIGTIARILGFAFGDGYLGEMGGRLTLTFYGKEETLRELKKDLERLGISANLYVRESIETTSGHSEGKSLSIELRVTSRSFALFLEKLGMPRGKKTEKAYRVPGWILEAPLWVKRNFLAGLFAADGSIVEFKGNTPLPINLTQSKSDELAENLVEFLGDVAKLLAEFGIETTLYEVKSKKGVTYRLSIVGEDSIRTFVERINYEYDPEKKVKGLIAAAYLKLKERIVKEAHEAVKDDFPTFEEFAKERGYEGGFVAEKVVKVERVKPEYTKFYDIGVYHEAHNFIANGIVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 231 - protein, 783 aa, Artificial Sequence
  Synthetic construct intein-modified proSavinase_S135:Pab_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVDGDTLVLTKEFGLIKIKDLYKILDGKGKKTVNGNEEWTELERPITLYGYKDGKIVEIKATHVYKGFSAGMIEIRTRTGRKIKVTPIHKLFTGRVTKNGLEIREVMAKDLKKGDRIIVAKKIDGGERVKLNIRVEQKRGKKIRIPDVLDEKLAEFLGYLIADGTLKPRTVAIYNNDESLLRRANELANELFNIEGKIVKGRTVKALLIHSKALVEFFSKLGVPRNKKARTWKVPKELLISEPEVVKAFIKAYIMCDGYYDENKGEIEIVTASEEAAYGFSYLLAKLGIYAIIREKIIGDKVYYRVVISGESNLEKLGIERVGRGYTSYDIVPVEVEELYNALGRPYAELKRAGIEIHNYLSGENMSYEMFRKFAKFVGMEEIAENHLTHVLFDEIVEIRYISEGQEVYDVTTETHNFIGGNMPTLLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 232 - protein, 1003 aa, Artificial Sequence
  Synthetic construct intein-modified proSavinase_S135:Pan_CHS2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLSPDTMVRTTNGDKPIRDIAVGDQLFDHEDRPVQCLAAEAIQTSRMMKVTYTGYNSVSKSSFTCTPDHIMTLVAYGVKPFRHSNSNRVTWWTRCDRTELGADAVEIKWDAAMHDLYTEYREQLGRRPTDAEVRKYLKAITSTRVVPDSEDDDSQRVEETYQSPVLIKLLAKLKAMDVDVDGEDESVVLMLLQQHMEDYLEHMIPEPEDISDEDNDDLIIDLDTNRKRKIGTISTLSSRISDKTFRQSPSIKSSPVNSQQQSQNEASQSTVPTYASVLTEDDHREMFAPVRSKLAVRDPKCKCQNLSCKGLRRVSTVFETSEQADLALELLSGDHYRVVDPCAVQDMEVFTMTLEEYQATCTAPMTQHKSKLRLYRSPLRFQPYQGSVSPVPIDPFWFGFWLGNGTKNNSEITSTDPEVEVYTQALVDRLNRDSIPPGKAPLKVSKYKIDIGTKHVYKGEEIKTTKVAHRLRVMSTVSNLDKTHWNPVHDGLRELGLLGDKSGGIPDCYMNADENTRLAVLAGLIESDGWLSHGLNCYGFGQYTYELKKLVEDARKLALSCGIQCNPIFERKNGKDRPEPGWFFYMGRGVEKFQPHLLLPRKRMTIPFTTSKNRDVRPFDVEDAGDGEFRLIEVSGELFQLADRTVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 233 - protein, 927 aa, Artificial Sequence
  Synthetic construct intein-modified proSavinase_S135:Pbr_PRP8
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAKGTLLLRYDGTKVEVENVREGDLLLGPDGGPRRAFNIVGGRDRLYRIKMEGGKEDLVVTPNHILVLHREKRDGVDKVYARPFALPLLQEDATDDGEDLSEISAIEHFDTMEITAADFASLDPNERKLYRLFTSPGYELNGRPVPIDPYFLGLWLGDRSRTKSSIYTNHEEEIREFIADHAAELDLQLVSYVSNRPSLAAMKNGNQLPLRHQARQTIRKQRIAAKSITQPGGARSSSYPATNGGLSSNTVTSLHSRERHPLSESSAAATMNLLPRSTSVSTSVAAQPKSSMSTFITDAILPSESSNISVISDSGIEISKSSKMLSEEEADLDLFDIDSEDEEIEDLDEKKNVSNVDEFPKRRRIHYLRTGCRTYGELCPGEEDQILEDIVGRPDGTTSVESLLLALEALGLHTCGTNDSGSDKKRIPSVYMKNSRAVRLALLAGLIDSGGWYVDSENTFGFSQTEDSNSTLIWDVVTLARSLGFSVSTKRRMTHKPTRTQHKAQEFAQISGNVAEIPSLLARERGVERPISQAHSFKIKDIQLETEATEWAGFRVDQDQLYLRHDFLVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 234 - protein, 515 aa, Artificial Sequence
  Synthetic construct intein-modified proSavinase_S135:Pch_PRP8
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAKGTRLLRYDGTEINVEDVREGDQLLGPDGEPRRAFNIVSGIDRLYRVKIGGEKEDLVVTPNHILVFYREGPSDGPENAERQTVEITAAEFATLSTEERSLYSAFTSPAVEKGAEGSAAQMHSFKVEDISLESEKTEWAGFRVDKDQLYLRHDYLVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 235 - protein, 721 aa, Artificial Sequence
  Synthetic construct intein-modified proSavinase_S135:Pfu_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVAPDSLVVVNDKVQEIGKLTEEWGREVGFLEYSSGIFYAPYLGRGISLDLVTGKVKPSVVSKVWKLKSPEELVTIKTITGKEITVTPETKLLTFNGTLEWKEAGKIKPGDYVLTVKKLHINGKQETLDEKLAYKRGLSLSDPLEFFSSSERTISAYLKGIFDKVGRLVGDTAVIKVDKDMAKRLQILLLRLGIVSSVDETGKVIIGREYIQKILGYNVSVVTHEVELFREFIAEISKFYGTSEEDVYSSLHEKGELDIGTVPVELPEGLREEINRERATYSELVKIAQEIKDEKLYNKLAWILSEVTEEEAKIKEKVNTLKVILSSDLIPERVESVKIIKSPYPYVYDLTVEGSHSFIANGFVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 236 - protein, 741 aa, Artificial Sequence
  Synthetic construct intein-modified proSavinase_S135:Pfu_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLLPEEKVVLPEIGLVTLRELFELANEVVVKDEEKEVRKLGKMLTGVDERGNVKLLNALYVWRVAHKGEMIRVKVNGWYSVTVTPEHPFLTNRGWVKAGELKEGDYIAIPRRVYGNEDLMKFSKIAKELGIKGDEKEFYLAGASLDIPIKVLFLAPSKLVSAFLRGYFDAKGVVRENYIEVPLFEDLPLLLLRFGIVSRIEKSTLKISGKRNLELFRKHVGFTDSEKAKALDELISKAKESERYPILEELRRLGLLFGFTRNELRIEENPTYEVLMEILERIERGSPNLAEKIAVLEGRIKEENYLRILEEEGLIENGKLTELGKELLEVWRNREFDSKDVDYVRNIVENLVFLPVEKVERIEYEGYVYDVTTETHNFVANGILVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 237 - protein, 876 aa, Artificial Sequence
  Synthetic construct intein-modified proSavinase_S135:Pfu_KlbA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGALYDFSVIQLSNGRFVLIGDLVEELFKKYAEKIKTYKDLEYIELNEEDRFEVVSVSPDLKANKHVVSRVWRRKVREGEKLIRIKTRTGNEIILTRNHPLFAFSNGDVVRKEAEKLKVGDRVAVMMRPPSPPQTKAVVDPAIYVKISDYYLVPNGKGMIKVPNDGIPPEKAQYLLSVNSYPVKLVREVDEKLSYLAGVILGDGYISSNGYYISATFDDEAYMDAFVSVVSDFIPNYVPSIRKNGDYTIVTVGSKIFAEMLSRIFGIPRGRKSMWDIPDVVLSNDDLMRYFIAGLFDADGYVDENGPSIVLVTKSETVARKIWYVLQRLGIISTVSRVKSRGFKEGELFRVIISGVEDLAKFAKFIPLRHSRKRAKLMEILRTKKPYRGRRTYRVPISSDMIAPLRQMLGLTVAELSKLASYYAGEKVSESLIRHIEKGRVKEIRRSTLKGIALALQQIAKDVGNEEAWVRAKRLQLIAEGDVYWDEVVSVEEVDPKELGIEYVYDLTVEDDHNYVANGILVSNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 238 - protein, 755 aa, Artificial Sequence
  Synthetic construct intein-modified proSavinase_S135:Pfu_Lon
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFSGEEVILIEKDGEKKVFKLREFVDGLLKEASGEGMDGSIRVVYKDLQGENIKILTKDGLVKLLYVNRREGKQKLRKIVNLEKDYWLALTPEHKVYTIKGLKEAGEITKDDEIIRVPLTILDGFDVAEKSIREELERLSLLPLNSEDSRLEKIAGIMGALFGSGGIDENLNTLSFVSSEKKTIEQFVKALSELFGEFDYKIEEKENSIIFRTCDKRIVTFFATLGAPVGDKSKVKLKLPWWVKLKPSLFLAFMDGLYSSNRNDKEILEITQLTDNVETFFEEISWYLSFFGIKAEAEEDEEKDKYRARLTLSSSIDNMLNFIEFIPISFSPAKREKFFKEIEKYLEYSIPEKTEDLKKRVKRVKKGERRNFLESWEEVEVTYNVTTETGNLLANGLFVKNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 239 - protein, 879 aa, Artificial Sequence
  Synthetic construct intein-modified proSavinase_S135:Pfu_RFC
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTGDTKVIANGQLFELGELVEKLSGGRFGPTPVKGLKVLGIDEDGKLREFEVQYVYKDRTDRLIKIKTQLGRELKVTPYHPLLVNRENGEIKWIKAEELKPGDKLAIPSFLPLITGENPLAEWLGYFMGSGYAYPSNSVITFTNEDPLIRQRFMELTEKLFPDAKIRERIHADGTPEVYVVSRKAWSLVNSISLTLIPREGWKGIRSFLRAYSDCNGRIESDAIVLSTDNNDMAQQIAYALASFGIIAKMDGEDVIISGSDNIERFLNEIGFSTQSKLKEAQKLIRKTNVRSDGLKINYELISYVKDRLRLNVNDKRNLSYRNAKELSWELMKEIYYRLEELERLKKVLSEPILIDWNEVAKKSDEVIEKAKIRAEKLLEYIKGERKPSFKEYIEIAKVLGINVERTIEAMKIFAKRYSSYAEIGRKLGTWNFNVKTILESDTVDNVEILEKIRKIELELIEEILSDGKLKEGIAYLIFLFQNELYWDEITEVKELRGDFIIYDLHVPGYHNFIAGNMPTVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 240 - protein, 727 aa, Artificial Sequence
  Synthetic construct intein-modified proSavinase_S135:Pfu_TopA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLHPDTLILTSQGVRKIKELSREGEVFALDFNLKLSKAKYRLLERDADEQMYKVTLLDGTELYLTADHPVLVYREGNLAFVPADKLRETDHVVLVLNKSARDNYGFLDLLLEITDSQEDYAILENGETLSLHSLKMLVERGEIKDIAVVGFSHNNFGKVMLRDELWYLIGYLAGKGGEIKGNGVVISSRTKEIVGLTKSLNIDLIETEEGIVLSNKSFVRLLHLIHYTPRVPEVYGIINNTEWLKAFLAGYYDATLLEGLTLEALYKIKVYLQLLGIRAKIEDNKLKVHLEDLQRFRELLGKFSRRKLYVETSQVPVFTDFDERSYDFPRILGGDIYIIGIKSIEKFHYKGKVYDLVVENYHNFIANGIAVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 241 - protein, 614 aa, Artificial Sequence
  Synthetic construct intein-modified proSavinase_S135:Pho_CDC21-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 242 - protein, 798 aa, Artificial Sequence
  Synthetic construct intein-modified proSavinase_S135:Pho_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 243 - protein, 829 aa, Artificial Sequence
  Synthetic construct intein-modified proSavinase_S135:Pho_LHR
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVSGDSKVLTEKGPVEIRHLNSGMIVGINGFKSRFVKFQELHQVKYQEYGVKIRTQLGFEVKCTREHRFLTIDKNGELRWVEAWRLKEGDYVGIIRKLPSPNSKVLILDFLPESTYLWLNKEFLKKLKVSIKEKFGSIKNYAKERGFNSSYLVKQLNGLSPFRWGRLRVILNDVSIEISRDDIERITSRRGKYSLPPELTPGIARLLGFWMASGSLNRNTLIFYSQDKKILERYEDLCKREFRVKGRIKAQDKGTYILEIPSSLLSFVFKNLARPKLEVPPIIYILPEKHKEEFLAGYFDGNGFIKIENGRIHSLGFFAFNRKFAEGIRDILLQLGILSSINEQTFEVSIIEGEKFLKIVNSWRSNYYKEWEDVIPNLEKRLKEIEEKLGYPGTYNRREIRRSELKAIIKLYEKVARERGLNDVLKELSYLKELSEGDIFFDRITSIEPVYLDVAYGIINSETGNYVVNGFVSKNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 244 - protein, 828 aa, Artificial Sequence
  Synthetic construct intein-modified proSavinase_S135:Pho_Lon
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFSGEEVIIVEKGKDRKVVKLREFVEDALKEPSGEGMDGDIKVTYKDLRGEDVRILTKDGFVKLLYVNKREGKQKLRKIVNLDKDYWLAVTPDHKVFTSEGLKEAGEITEKDEIIRVPLVILDGPKIASTYGEDGKFDDYIRWKKYYEKTGNGYKRAAKELNIKESTLRWWTQGAKPNSLKMIEELEKLNLLPLTSEDSRLEKVAIILGALFSDGNIDRNFNTLSFISSERKAIERFVETLKELFGEFNYEIRDNHESLGKSILFRTWDRRIIRFFVALGAPVGNKTKVKLELPWWIKLKPSLFLAFMDGLYSGDGSVPRFARYEEGIKFNGTFEIAQLTDDVEKKLPFFEEIAWYLSFFGIKAKVRVDKTGDKYKVRLIFSQSIDNVLNFLEFIPISLSPAKREKFLREVESYLAAVPESSLAGRIEELREHFNRIKKGERRSFIETWEVVNVTYNVTTETGNLLANGLFVKNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 245 - protein, 814 aa, Artificial Sequence
  Synthetic construct intein-modified proSavinase_S135:Pho_Pol_I
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSILPDEWLPIVENEKVRFVKIGDFIDREIEENAERVKRDGETEILEVKDLKALSFNRETKKSELKKVKALIRHRYSGKVYSIKLKSGRRIKITSGHSLFSVKNGKLVKVRGDELKPGDLVVVPGRLKLPESKQVLNLVELLLKLPEEETSNIVMMIPVKGRKNFFKGMLKTLYWIFGEGERPRTAGRYLKHLERLGYVKLKRRGCEVLDWESLKRYRKLYETLIKNLKYNGNSRAYMVEFNSLRDVVSLMPIEELKEWIIGEPRGPKIGTFIDVDDSFAKLLGYYISSGDVEKDRVKFHSKDQNVLEDIAKLAEKLFGKVRRGRGYIEVSGKISHAIFRVLAEGKRIPEFIFTSPMDIKVAFLKGLNGNAEELTFSTKSELLVNQLILLLNSIGVSDIKIEHEKGVYRVYINKKESSNGDIVLDSVESIEVEKYEGYVYDLSVEDNENFLVGFGLLYAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 246 - protein, 526 aa, Artificial Sequence
  Synthetic construct intein-modified proSavinase_S135:Pho_RadA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 247 - protein, 764 aa, Artificial Sequence
  Synthetic construct intein-modified proSavinase_S135:Pho_r-Gyr
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTPDTLVSLSDGRIIEIREAVENSEESLLGINGLKPKEAKALKFWEIDWDGPIKVIKLKNGHEIKATPDHGLLVMRDGKIGWVSAKNIREGDYVAFIYNLGHRGGKKYTLPQLLKELGISEYENSSSQELNNREQEMDSKQISIELDERFWYIFGVILGKGTLKGDKVVIFQKDVKPVIEEALPFVRIFESADHIGFSHLILAEVFRRLGVGEGKLHSLVFGLREEYINAMIAGYFDASGTFLRRAVLTSKRGDILRMLSVYLYQIGIVNNLRRDEHAGVWELIISDLEKFREKIYPYLRIKKSQFDKVYSISKNEGDFLPVASIFRKLKFRDGFKNRILDEEIPRDEVAKVLEYAEDSPEKEFLNSLVEARVTWVRVEKIEERHYTGKLYDFTTTTENFISNGIVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 248 - protein, 744 aa, Artificial Sequence
  Synthetic construct intein-modified proSavinase_S135:Pho_RtcB_Pho_Hyp-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAPGTRVLTEHGYWLKIEEMPEKFKLQRLRVYNIEEGHNDFSKVVFVAEREVGSEEKAIRIVTESGKVIEGSEDHPVLTPEGYVYLRNVKEGDYILVYPFEGVPYEEKKGVILDESAFEGEDPQVVKFLRERNLIPLQWKDPKVGILARILGFALANGYISENDNLTFHGKEEVLREVRKDLEELGIEAIVAEEDKLKVTSREFAFLLEKLGMAHDSIPEWIIEGPLWIKRNFLAGLFGANGSIVEFKGDVPLPITLTHSRELLNDVSRILEGFKVRAKIKMGKNGSYQLVIEDEDSIRNFLGRINYEYDPEKKARGLIAYAYLKFKELMKGNLMTFEEFARDRGYEGGFVAEKVIEVKSVKPEYDKFYDIGVYHSAHNFIANGIVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 249 - protein, 730 aa, Artificial Sequence
  Synthetic construct intein-modified proSavinase_S135:Pho_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVDGDTLVLTKEFGLIKIKELYEKLDGKGRKIVEGNEEWTELEKPITVYGYKDGKIVEIKATHVYKGVSSGMVEIRTRTGRKIKVTPIHRLFTGRVTKDGLILKEVMAMHVKPGDRIAVVKKIDGGEYIKLDSSNVGEIKVPEILNEELAEFLGYLMANGTLKSGIIEIYCDDESLLERVNSLSLKLFGVGGRIVQKVDGKALVIQSKPLVDVLRRLGVPEDKKVENWKVPRELLLSPSNVVRAFVNAYIKGKEEVEITLASEEGAYELSYLFAKLGIYVTISKSGEYYKVRVSRRGNLDTIPVEVNGMPKVLPYEDFRKFAKSIGLEEVAENHLQHIIFDEVIDVRYIPEPQEVYDVTTETHNFVGGNMPTLLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 250 - protein, 728 aa, Artificial Sequence
  Synthetic construct intein-modified proSavinase_S135:Pna_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTADTRLATQHGLVPIGWLQANGGALDCTVDRRALGEDRRGTVTRAAVPAFLSAGQAEVFKVTTAEGYQIKATAWHEFYTARGKLKLSELKAGDELWVQSGKGQFGAQGSGALGLLIGLITGDGHFTNRGKDEQAAVISLWGEERQLADDIAGSVNALIAGTSLAPRDYLVKPVAVAERNMVFIRSTMLVRVLDGYGFNGETKLEVPEVVWRGSEACMRGYLQGLFQTDGTVNVSSNSQSCSVRLSSSHRPLLQDVQVLLANFGVFSRIHERREAGPRSLPDGQGGQRDYLCQTQHELIVDGESREAFMREIGFLLPAKREKYDAWVADKALVKTQRFAATITAIEPAGVEPVYDTTQPDGNTVIFNGLVTGQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 251 - protein, 810 aa, Artificial Sequence
  Synthetic construct intein-modified proSavinase_S135:Pno_RPA2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLSADHEVLTSTGWKALPAIKDADQVMTLDLQTGTQQWNSVQATTRFAREGSLYRLKSDDMDAVCNESHRWYLNTKDQPTTYTAFTTQQMLDNQLVALRNSSGKATDQWNHESGTTTHTNHNIPTVGHNGNVMFSWPDCPWLPREFVADEACNLDWCRFIGLVMGDGSIDHVTDAQGQEHYSIQIHQRAGNPASNANTEDVLERLAAKLPNFVVHPSCVSGAEEKHTWTINHRDMYHFFLPMMRGPQSYDPLDNAMCRTYQAPDYQALSRSDNEPIIPVPADWKTGNWWHLRRWINYPWLFSLAQSQARAMIKGMAAANGDWSLSLKARLDTGDSGVVRVFSNSIPLMHDMSVLGLLADTRVNIGVDHKKGQMQLQVPVTMPALLAWCISFSFANSDLAVAAPKPEAYDNPRHDGFVYCLTVPNGNFLARRTVEYSDNDKIQEVIDAAQKPFFTGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 252 - protein, 734 aa, Artificial Sequence
  Synthetic construct intein-modified proSavinase_S135:Posp-JS666_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTADTWVMTTAGPAQVSELTGRSFSAVVDGKAYAVTSDGFFRTGHKPVLALRTREGPALRLTADHRVRRVARRTRYTLEAEWTEAGQLQPGDEILLHDHRALGGWEGAGTHAEGYLLGLLIGDGTLKSDKAVISVWAPELKVAGGGAVAYAQTGAGGIVQAAEAAAATLSHRVDFRGFQRSISGRGEARMASGAVRHLAHEMGMRPGHKTITTAMEKASSVFTEGLLRGLFDADGSVQGSQEKGVSLRLSQSDLSLLQTAQRMLLRLGIASTIYPNRRLAQARPLPDGRGGLRVYETASQHELVISADNLRIYAERIGFADTDKADRLDQALGSYNRSLNRERFTVTVESLTEEGSEDVFDVTVADIHAFDANGLYVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 253 - protein, 720 aa, Artificial Sequence
  Synthetic construct intein-modified proSavinase_S135:PP-PhiEL_ORF39
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGAGVLSSKIKIPGGWKTMGNIRVGDEVVTPDGGTAKVLAVHPQGVTKVVRVHFKDGRYTDVSPDHLWKVRRHHWCNDKAMAKLTREEVEERVWRVITTNELKDYIGLSTKVYVQLIEPERNADKPFKIHPYVLGVLLGDGCISQKAVDITKPYQQLFDKVQSLLPEHLECVWRPNRKGDGEPKTFGIRFKDRRSEQHINWHIRDGLKELGLYGMRSWGKVIPEEYLHGSAKQRLELLQGLLDTDGTVDKHKSVSFSSSSKLLSLGVQYLVRSLGGMARLQERTPHYTHNGEKREGRTDYRVYIRYPRPEELFTLDHKRERAVSHQHTETLRLQVTHIEERPDEETQCITIDHPDHLYITDDFIVTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 254 - protein, 803 aa, Artificial Sequence
  Synthetic construct intein-modified proSavinase_S135:Pst_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAKGTKVLMANGDDKNIEDIAVGEEVLGKDGLPREVVALPRGRETMYEVSEKTQHRAETVFGTASYTCNATHKLVLQTNQRVNITNHVLRGESQTSVTYFQMKTAVADGREIELPKLCTKSFQHSSHGRENAWKKAEVFASTISRDPIDWTAEARDISRLGYHVRRATRQLWSPVLVEKEVLAPMIAKRGFDESIAPYMAYLVGLWVGDGYSDRATFSIDIQDVEIHERIKDFASHAGLTPRIACYKKSRDATISLHNSETRGKNVRQNLNTGNLLWSLLAEICGKKENEMLFKLVPSFLRSESIAVREYFISGLVDSDGHVKRDEADKCYSATVKTIYPAVRDGLVSVARSLGIQTSVSVEEAKEVNSVKHQESYAIYMANSSALDSVLSKCAAPRKRAEEPVCVNREPHPYTFHMVEKEEDDFYGITLSEDSDHQFLLSNLALVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 255 - protein, 782 aa, Artificial Sequence
  Synthetic construct intein-modified proSavinase_S135:Rma_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAGDTLITLADGRRVPIRELVSQQNFSVWALNPQTYRLERARVSRAFCTGIKPVYRLTTRLGRSIRATANHRFLTPQGWKRVDELQPGDYLALPRRIPTASTPTLTEAELALLGHLIGDGCTLPHHVIQYTSRDADLATLVAHLATKVFGSKVTPQIRKELRWYQVYLRAARPLAPGKRNPISDWLRDLGIFGLRSYEKKVPALLFCQTSEAIATFLRHLWATDGCIQMRRGKKPYPAVYYATSSYQLARDVQSLLLRLGINARLKTVAQGEKGRVQYHVKVSGREDLLRFVEKIGAVGARQRAALASVYDYLSVRTGNPNRDIIPVALWYELVREAMYQRGISHRQLHANLGMAYGGMTLFRQNLSRARALRLAEAAACPELRQLAQSDVYWDPIVSIEPDGVEEVFDLTVPGPHNFVANDIIAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 256 - protein, 726 aa, Artificial Sequence
  Synthetic construct intein-modified proSavinase_S135:Rsp_Rir1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTAETWVMTDEGARQVSALLDRPFRAVVNGIAYDSGEHGFFCTGLKPVKRLSTACGRHLRLTADHLVRKVVGKTRWRQEVEWVPAGDLRPGDEVKLHDHRTAMIQTRPEDERGYLLGLLIGDGVIRDDKTLISVWPQEECIGAQPLGHPVMHKVEALLRDLPHRADFAGWQKVEGRGEYRIGTAALTALAAEYGLTRGRKTITPEIEGAETAGFGAAVLRGLFDADGSVQGAQEKGVSVRLAQSDLALLQAAQRMLARLGMNAVIYENRREAGRAFLPDGKGGQAHFETKAQHELVISGENLATYQERIGFTDVAKARRLAVALSGYKRALNRERFSAVVADVVDDGMAEVFDVQVPGVNAFDANGFYVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 257 - protein, 702 aa, Artificial Sequence
  Synthetic construct intein-modified proSavinase_S135:SaP-SETP3_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLKRGTEVIMFDGTTKKVEDVIVGDVLMGPDSTPRNVLSLGRGREMMYEVKPRKGESYTVNESHILSLRTTTGIAKGSWPDNTVFDISVRDWLKLPKYVTGPNGYLKGWRVPVDFPRKEQDEALLPPYLMGLWLGDGTSSSGAITSGENEKEIRAYLESYAARNGMQIRKEGLTWSISHGNTGHKKHGFTHALKSAGVLNNKHIPHNYKCGDRRQRLELLAGLLDSDGYCDLSKAGFDWISVSERLADDFCYLCRSLGFAAYKKKTCKRCANTDVWGDYFRVSVSGDFSEVPFVRGRHQNLPKRNINKNVLNVGIESITPVGVDDYFGFTIDGDSRFLLGDFTVTHNTSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 258 - protein, 692 aa, Artificial Sequence
  Synthetic construct intein-modified proSavinase_S135:Sav_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGAQPLDSLVLAPTGFRRMGDLREGDEVVVPNGEIALIDGVFPQGVRDVWRIVLSDGSSVECDDEHLWIVGTSCGWHRGQTPKVMTTREIRLDTFKANGSSKWYVPAATPVDLGPDVGLPLDPYLFGLLLGDGSFRHNLRLSTVDDEIRDAAADAVAPDCRLVPVTGSRCDYTIQLKQRSGGVRNPVIQALRRLDLWGKTSHGKFIPEDFKNTSIKNRLSLLQGLLDTDGTVHADGMSVSLRSASLRLAEDVAWLVRSLGGRARVLPEKAAFHVSVALPDEYAPFRLSRKADRVRPRPKYNTFRRGIRAVEYVGRKPAQCISVGHPSHAYVTDNFTVTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 259 - protein, 853 aa, Artificial Sequence
  Synthetic construct intein-modified proSavinase_S135:Sex-IFO1128_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAKGTQVMMADGSDKSIEDIQLGENVMGKDGTPRTVISLPRGKETMYEVCHSSTKGTTKDTLMNYVCSGNHKIVMQTPQQIGITEHGIDGKTYTSVSYFALRDSQHGYPIVKKLTKSFEHQQHGGKEQTLITVNNFVSSLKSEPINWDVEAKHYESLGHYVKKCSYQLINPVFHQSGKLAQEIASLNYSKDKAPLLAWLIGFWVGNGAMRHSQFVVESQDIELVNRIQDIAGLLNLSATTACYYSGSKDDEAKLAKLNSSSAEGFEDDLEGNPSVKELADMDRLSESKTATLPTAFGVENIDELIISLGEGRGNGNVFAQVIGSFGIDLADKDTLVTKIAHELAGDAFEVREQFVAGLVDAAGYVRKDVYDHASEATISTESKSTVLGLVKIARSLGIKITVTSDDSDDSDEHDHAHCGHDHGSSSSYTAVMTGDALTNSMRFCAIGRNRVAAKEFMRQAVPFYFSLEKKSEDDYYGITVPDNTDKQYLLSSMALVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 260 - protein, 834 aa, Artificial Sequence
  Synthetic construct intein-modified proSavinase_S135:Smar_1471
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSVSYDTPVLIRDPINKIHLVKIGEFIDKFYEEGEERTAKHVNGYYVLSHDGFQVVWKPIKYVLRHRTNEIYEIIYEGGGKLEATGSHSVFVLDPDTLDIVEKPVMLLNKGEYLVSFNGVKENKDHQTIDLIDLVSDYNDVYVDNIPSELKKHTGGRNPIPLKQYMILRKRVITKKNNSLIKLRRSKYTLPIRLVLDEKLAFLFGAYIANGCVKERRDKLICFTFGKSAKNIADKVMNIMYEKFNIKPFIDDRGTYIIYEYPHTLLAIIFEKLLGRKLEEKKMPEILWSSPKSVIRAFFEGLRAYSQRTLRRRYTSYTTANKNLAYQLLWLARFAGFYSVLKEEKEAGKNNGKTYYHVIVYLDQSYRKPNASERVPVKPILKLIKYTKPRTMPPELAYIKRREFISRKTALKALEWIRRDGSFTDFSREYLRKIESLINGDIIVLKIKDVRKKQYKGYVYDISVPITEAFFGGNIPILLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 261 - protein, 704 aa, Artificial Sequence
  Synthetic construct intein-modified proSavinase_S135:Smar_MCM2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSYHKDFKIMLADGRKVRIGDLVDELIGKNREKVIKGKDTEILFVDDLFLLSYNMRSGEQVLVKADRVSRHKAPDQFIKLRFSNGAEIIVTPEHPVLIINNGKIKTVRADTVRKGTLTIGVLGHKIIKEVNEDDIINNIRRKIVLDKELPYIHAKNISEAVEMRDQLMSIDIPTFIVKHKNEIRLYPSGPCSLRRLLLMHGVEEVVFSDELLYEIMNCHLYPATWYELLYSMGLTKIAKELNVYDFEILAGIIKKVEKEVIMLSQVLGLRNETQTELLHLKSRRELLIRLKDKLDMLRKRLKDLEEALGKDAVIRMITDVEVIKNTDSDWVYDITIEPYHLFVSDGLILHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 262 - protein, 698 aa, Artificial Sequence
  Synthetic construct intein-modified proSavinase_S135:Sru_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLGKGTPVMMYDGRTKPVEKVEVGDRLMGDDGSPRTVQSLARGREQMYWVRQKRGMDYRVNESHILSLKKSRREGARDRGSIADISVRDYLDQSDKWKDDNKGFKVAAEFPDQPVPLDPYFLGLWLGDGKSDNARIYTTDEEVITGLQEIAEKRGDTISVSDEHRRCPAYLVKSGDRGGAMATRESVQGALRALGVLGDKHIPHLYLGNSRGKRLRLLAGLIDSDGHLNDGHGGTYEITQSSEQLARDIKFLCDTLGYRTSLTQKTARISSTGYESEVHRVRFNGNVDEIPVRVERKKASPWTDVRDWRMTGIDVEPDGVGDYFGFTLDGNGRFLLGDGTVTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 263 - protein, 712 aa, Artificial Sequence
  Synthetic construct intein-modified proSavinase_S135:Sru_PolBc
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFDPETEVVTVDGIRHVEEIEVGDRVYSLNPDTGAVEIKPVTATQSQHYAGPMVEIKNQHTDFLVTPNHRFLTQRFTSGEYTDLEWETAGDMLGDRIRRRLPSLRSLPATQERPGPISLSAVCDRLAIEHKTGPRGIKELRRQARWQPEEYELTDWLRILGWFATEGTLYKSKARQYENGNVRGVSYQTTLCQKNDIGRSEIATLLNRTGITYSSDQNDHSFCSKVLYEILEAECGSDSFSKHLPPWIFQLGPKDLKIVFDTLMQGDSAANGDRFTTSSNQLAEDFIRLAMHIGRRAFHMPNDGSHRIQVNTVRGQRPTIKPKHRQQVDYDGMIHCLTVADNHTVLAGRNRKFNWTGQSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 264 - protein, 783 aa, Artificial Sequence
  Synthetic construct intein-modified proSavinase_S135:Ssp_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCISGDSLISLASTGKRVSIKDLLDEKDFEIWAINEQTMKLESAKVSRVFCTGKKLVYILKTRLGRTIKATANHRFLTIDGWKRLDELSLKEHIALPRKLESSSLQLMSDEELGLLGHLIGDGCTLPRHAIQYTSNKIELAEKVVELAKAVFGDQINPRISQERQWYQVYIPASYRLTHNKKNPITKWLENLDVFGLRSYEKFVPNQVFEQPQRAIAIFLRHLWSTDGCVKLIVEKSSRPVAYYATSSEKLAKDVQSLLLKLGINARLSKISQNGKGRDNYHVTITGQADLQIFVDQIGAVDKDKQASVEEIKTHIAQHQANTNRDVIPKQIWKTYVLPQIQIKGITTRDLQMRLGNAYCGTALYKHNLSRERAAKIATITQSPEIEKLSQSDIYWDSIVSITETGVEEVFDLTVPGPHNFVANDIIVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 265 - protein, 789 aa, Artificial Sequence
  Synthetic construct intein-modified proSavinase_S135:Ssp_GyrB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFSGDTLVALTDGRSVSFEQLVEEEKQGKQNFCYTIRHDGSIGVEKIINARKTKTNAKVIKVTLDNGESIICTPDHKFMLRDGSYKCAMDLTLDDSLMPLHRKISTTEDSGITIDGYEMVWSPRSDSWLFTHLVADWYNRWQGIYIAEEKQHCHHKDFNKRNNNPDNLIRLSPEKHLALHRKHISKTLHRPDVVEKCRRIHQSPEFRRKMSARMQSPETRAILSKQAQAQWQNETYKLTMMESWRSFYDSNEDYRQQNAEQLNRAQQEYWAQAENRTAQAERVRQHFAQNPGLRQQYSENAVKQWNNPELLKWRQKKTKEQWTPEFREKRREALAQTYYRKTLAALKQVEIENGYLDISAYDSYRISTKDKSLLRFDRFCERYFENDENLAREAVLNYNHRIVNIEAVSETIDVYDIEVPHTHNFALASGVFVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 266 - protein, 774 aa, Artificial Sequence
  Synthetic construct intein-modified proSavinase_S135:StP-Twort_ORF6
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCISMDSMILTTEGYKSLQEIFETQGVKVDNKEKVIELKYPLINRYGDVEYTSHFTKNGEKPTKRIKTNKGIELVNTYNHPLLVREGFNLIWKKSEDIEVGDILVSRVGDHQFGNNNTVENEEEAYALGCMVADSYLGSYSRLSFSNDKKEILDKVSKFWNTFSNKEVYYDTYKESKGITIHLHDTNKTKEFHDKYKIEYGVAKDKKIPKCIMESPENIQLAFVSGYLECESSISEKNLEVTSASKDLLKDLQLILSNIGIVSTNKEKVVKKYKHNKYYRLIVNRKELIKLLPLLRFETQQRKNQKENFLSNNTKIKSSYGNTIEGSRYLLKKYRDSLNIDKKEFSKYLSRDTITIDRLREVISLYPDGDKEIRELFENVVNNNIYYQKVEQVLEGEIIPTFDVCMPKTHSFIANTIVNHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 267 - protein, 714 aa, Artificial Sequence
  Synthetic construct intein-modified proSavinase_S135:Tag_Pol-1_Tsp-TY_Pol-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCHPADTKVIVKGKGIVNISDVKEGDYILGIDGWQRVKKVWKYHYEGKLININGLKCTPNHKVPVVTENDRQTRIRDSLAKSFLSGKVKGKIITTKLFEKIAEFEKNKPSEEEILKGELSGIILAEGTLLRKDIEYFDSSRGKKRISHQYRVEITIGENEKELLERILYIFDKLFGIRPSVKKKGDTNALKITTAKKAVYLQIEELLKNIESLYAPAVLRGFFERDATVNKIRSTIVVTQGTNNKWKIDIVAKLLDSLGIPYSRYEYKYIENGKELTKHILEITGRDGLILFQTLVGFISSEKNEALEKAIEVREMNRLKNNSFYNLSTFEVSSEYYKGEVYDLTLEGNPYYFANGILTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 268 - protein, 892 aa, Artificial Sequence
  Synthetic construct intein-modified proSavinase_S135:Tag_Pol-2_Tsp-TY_Pol-2_T134
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSILPNEWLPIIENGEVKFVKIGEFIDRYMEEQKDKVRTVDNTEVLEVDNIFAFSLNKESKKSEIKKVKALIRHKYKGEAYEVELNSGRKIHITRGHSLFTIRNGKIKEIWGEEVKVGDLIIVPKKVKLNEKEAVINIPELISKLPDEDTADVVMTTPVKGRKNFFKGMLRTLKWIFGEESKRIRTFNRYLFHLEELGFVKLLPRGYEVTDWEGLKRYRQLYEKLVKNLRYNGNKREYLVRFNDIKDSVSCFPRKELEEWKIGTRKGFRRKCILKVDEDFGKFLGYYVSEGYAGAQKNKTGGMSYSVKLYNENPNVLKDMKNIAEKFFGKVRVGKNCVDIPKKMAYLLAKSLCGVTAENKRIPSIIFDSSEPVRWAFLRAYFVGDGDIHPSKRLRLSTKSELLANQLVFLLNSLGVSSIKIGFDSGVYRVYINEDLPFLQTSRQKNTYYPNLIPKEVLEEIFGRKFQKNITFEKFKELADSGKLDKRKVKLLDFLLNGDIVLDRVKNVEKREYEGYVYDLSVEDNENFLVGFGLLYAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 269 - protein, 2340 aa, Artificial Sequence
  Synthetic construct intein-modified proSavinase_S135:Ter_DnaB-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCAAYDTLVLQKDGSLVTLAEVYKRQEIELLTLGKNSKFYLTKPSAFIDDGIKPIFRVTTKLGRFVETTITHPFLTVNGWKPLSKLQVGEKIAVPRRLNIFGNETISESKFSSLINFDNLYLFPLVFQLERSQLALFIRYLFSLDGWVKIYQNKIVCFGYSTVSEKLIRQIQHILLRFGIVSGIEKFEEKRTEKIKVVKEVKSQRSHREEFTFATYRNCYCDGKWHLTITDALSQKNLMEDIGGFDSKNFYLFDLLQPHNSGNQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTTKRNSPKNSENLTTTETICRKNILANMENLPSDNQNFDSEKLDLPQPHNSGTQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGTQELENSDIFWDKIVSIEPVGEKQVYDLTVPETHNFVANDICLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 270 - protein, 782 aa, Artificial Sequence
  Synthetic construct intein-modified proSavinase_S135:Ter_DnaE-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLSGSTKVIDAATGNLFSLKEIAAQPEYWLSRKVFSLDLKSQQVVQQPITEIHPNGVRDVWQITTRTNRKVCATDDHLFYTVLGWKPLKDFSVGDRLGLPNKIPINYRSQISDSKVKFTAYLIGEGYLYTNSFSCSYFCNSDGELIADFYGCAEELFGSSAPIEKQLHLGNKSVIYVRIGLISGLKNWVDSYLQCANSRVQEIPNWIFSLSQSQLQLFLGILWSTSGIFDETIGYTYYSSNSEVLVRQVQHLFLRLGIVSLFNVNKVKGQGELDVSYVVEVRGREDMLKFYKLIKPYLSSYKQGLCESCYLVIKYQQSYQFKYFLTPDFFDLIVKAKKASSMTRALGVCGGEISSVWNFQNTSNRSLSFDKFNNFSTVLADEELTAIANSDVFWDEIISIEYIGKEEVFDLTIPETHNFIANDFIVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 271 - protein, 491 aa, Artificial Sequence
  Synthetic construct intein-modified proSavinase_S135:Ter_DnaE-3nc_NC-terminal
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTYETEIMTVEYGPLPIGKIVEYRIECTVYTVDKNGYIYTQPIAQWHNRGMQEVYEYSLEDGTVIRATPEHKFMTEDGQMLPIDEIFERNLDLKCLGTLEMVKIVSRKLAKTENVYDIGVTKDHNFVLANGLIASNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 272 - protein, 784 aa, Artificial Sequence
  Synthetic construct intein-modified proSavinase_S135:Ter_Ndse-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSLTGDQKVLYYIAKKLYYETFAECYDRINGDISSVSVPCFDENYQTVIKPISAIWKHHVKKKGFKIKITWGKQIKITEDHSLFTRNENNKPQAVFGNEIKVGDEIGIPSYISFLEQPLEPFHITDKILIQEEIYVESEDTISYIEKYGDKMREYLLAKSLSPSQFYSILKTYEAKNQIPWHLWKYLELPLSEKDKVCYLSKKAIKNWIDNVEELLWFLGFYVARGSLIKNEVVLKGEPSQLEKVIELIERIFEYKSEINDSGYISIKSKILVDLIGYGLNFGNQEKDIPNWILQLPEQQLIRFLKGFVAGNNLENQLNFYLEFKTDSQLVAEKLVLILSKFGLVADVSEIEVNEEDIAKIYRIIIEGLEDKNIHNLSKVEQKISALTTGDIAWGKIESIEEFEIDDYVYDFSVPNYENFIGGSYNVFAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 273 - protein, 677 aa, Artificial Sequence
  Synthetic construct intein-modified proSavinase_S135:Ter_RIR1-3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVSGDTLLITRDSIHKIKDVVGQKIEIWNGKNWSQVIPLKTGKDRKLYRVRFGDGSYLDVTEYHRFFVKDRFGKKYEEVQTKDLLTHSKYALDVEPFIIDYHDGDSINLSYAYTLGAALGNGTIDQNSNGKIRVYSHKAELIFAGNKSLERQYNYLPSFVDVIDLGFSGELLRRLQTEPDALNTIASWNKSAILAFIAGLADTDGSETKGNGIKISVSDYERAKRLQLLLTKCGIRASVNLMASRGCTTNLGERNQDLYYLQITDCREIPCQRLDTTKVCEAKFQGKYQTIQNVEELPGLHDTYCFEEPEFHKGVFGNALTGNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 274 - protein, 735 aa, Artificial Sequence
  Synthetic construct intein-modified proSavinase_S135:Ter_RIR1-4
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLDKTALRIFNQGLLYADEVVTPGSGETVGLGLTVRNGIGASTAIANQPMELVEIKLANGRKLRMTPNHRMSVKGKWIHACNLKPGMLLDYSIGEYQKREDTLLIPLQLEDYTEVNNSQTLGHNGGVLTKKIMTPASMTSDLAYFLGCLFGNGCIVQNKYQVCFYHSRLDVLYGLQEKGKKLFGIKGSLNDFANGRFELCFASRQLFYWLHLNQLVKTQKSEDLERIPLSLRRSSRVTLLSFFCGLIDTNGYVPQDGKLSIASASSDFIHNLQQIGESIGLCFSIYQNTKGENLQNQHNNTWGLCLSPMLSNVDALDYLNHNSIKCQEGPVVISKCVLNYSPYKIESVNIGAVCDYSYDFAIEGINDNDSWYWQGALKSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 275 - protein, 823 aa, Artificial Sequence
  Synthetic construct intein-modified proSavinase_S135:Ter_Snf2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVLHDTEIYVNGMVMEAEQIWQAYAGEAEFDGEGFWTEPNKELLVNSLDETTGKIVFARIRRLYRQWVREKLRKVRLKDGSSITITCRHKLFIRDSWKNDFQVGDDVCVPAKLMWDGKPEDPDVVKFVAWQVAEGWERVNSGMFGVSQKGKDVLEGLLEVFSRLGKRYDIKINCPKVVAHGSKKNCYEFSAHSLEYRKFLEEKRYGWGKRSHEKTIPLFIMQADLDSVRVFLSNYFDAEGWVNKTVRCVEISTASSQLIQELSILLRRFGVWMKISPQQKCATNGTGVFCTYYIGTFGGNSARCFLQEIGFNDSGKQENLKSICEKIADSNVEGIPASDIVAELVEKTQLPVGSLGIQDPIYMDGCQDFSPTSLEKVINSIEDIISGAGEEEYGQLKSSKLRNKTLEAYSLLNILELEIYKTRLQKLLNQEVYYCQIESIEEMEYEGWVYDFEVSKYHNFVANNIICHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 276 - protein, 743 aa, Artificial Sequence
  Synthetic construct intein-modified proSavinase_S135:Tfu_Pol-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSVTGDTEVTIRRNGRIEFVPIEKLFERVDHRVGEKEYCVLGGVEALTLDNRGRLVWKKVPYVMRHKTDKRIYRVWFTNSWYLDVTEDHSLIGYLNTSKVKPGKPLKERLVEVKPEELGGKVKSLITPNRPIARTIKANPIAVKLWELIGLLVGDGNWGGQSNWAKYYVGLSCGLDKAEIERKVLNPLREASVISNYYDKSKKGDVSILSKWLAGFMVKYFKDENGNKAIPSFMFNLPREYIEAFLRGLFSADGTVSLRRGIPEIRLTSVNRELSDAVRKLLWLVGVSNSLFTETKPNRYLEKESGTHSIHVRIKNKHRFADRIGFLIDRKSTKLSENLGGHTNKKRAYKYDFDLVYPRKIEEITYDGYVYDIEVEGTHRFFANGILVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 277 - protein, 776 aa, Artificial Sequence
  Synthetic construct intein-modified proSavinase_S135:Tfus_RecA-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLTADTYVWTDRGLETVAEVFGRAGLPLSSTSRVTDVRDRDIRVVNEKGELEQVAALTHNGRQPVVRITVASGRQVTVTRNHPLRVMNDDGFIVWREAGQLREGDVLVSAAFGAVQAASGGGLSEDEAVLLGYLTAAGSLDPAGHVCFTTTDIETGAEFAALAEWLLDTTVTAVPGDGQVAYVLSDPAARHTLAERYGVDYAAAARIPQCVRTAGDKMQRAFLAALYTAAGWTDTSAAVGLRTASAPLAREVQYLLYGLGIPADLDRSHGNGQHPWAVTISPAAAPRFHTEVGFRTAQQSPQTGLHEPTPQVEAIPNLTGLIHALRDSIGDRAESTDDPFPAASGGAYDRDQVRRVIDWAKRRTDEAPATANAILGYLTQLTDARYTYEPITAVEDAGQQPTFDLMVPRTHSFLANGILSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 278 - protein, 711 aa, Artificial Sequence
  Synthetic construct intein-modified proSavinase_S135:Tfus_RecA-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCMHYDTLVTLADGTQEKIGTIVDRKLDVEVLSYDPETDRIVPRRVVNWFDNGAADHFLQFTVGRSGKPGGAQFTATPNHLIRTPGGWREAGELIAGDRVLVHEPHYLNEQQRQVVYGSLMGRGTLVPDRHGGPGVHFCMAHTAEQAAYLDWKVSLLGNIAHSRTAEASATVGVEFTPMPELSELHRVVDFGDGHTHLTWEFLKQLTPLALAVWYLDAGTLTIPQSGTDDDARVQIDVETLSPGSRQRLVEYLRDTHELDAAVVQQGADARSLLEFTPAATVRFLELVAPYVPESMSSMLLAQFRGRCSVTPEYSDPVQRLVAAPVLDIQVKPGSTRKFDIEVEGNHNYFVDGVMVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 279 - protein, 891 aa, Artificial Sequence
  Synthetic construct intein-modified proSavinase_S135:Thy_Pol-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRSVSYEKFRELVKSEKLDGEKAKRIEWLLNGDVVLDKVLEVKKRPYEGYVYDLSVEEDENFLAGFGLLYAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 280 - protein, 689 aa, Artificial Sequence
  Synthetic construct intein-modified proSavinase_S135:Tko_CDC21-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSYHHDFELLLADGRKVKIGELVDKLIEKNRDRVILGKDTEILPVEDIELLAYDLEKREIVKVKADRVSRHKAPERFIKLRFSNGREITVTPEHPVMVWENGEITEKPAEKITPGDIALGVLRYPIQVDGKFKERYRDMREAEDYQDYLYSRGVVSKIKRTGIYFTVEKARRALPRELVKPLINAGKILRVTQTPKERASFNQKLVRENIIEGYLQRIIERMDELERLSREDPAKALELLPKTQLYYKYGITYGKLKKLAEARNSWAEGIIQSAVAERISLAKRELEEFFKWWNANVNFLKVKCVEEIKNDRWEWVYDVTVEPHHLFVSHGLVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 281 - protein, 757 aa, Artificial Sequence
  Synthetic construct intein-modified proSavinase_S135:Tko_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCMHPDTYVVTKSGAKKVSELTEGDEVLTHTGTFKKVIQPLRREHKGRLLVIKAYGTVPVKITPEHMVWVVKQIRHKSHYSDGRQVIWWEFEGPEWMTAQELKERLESETDPKVSYMLLQPIPEPSVDADKIPLRKEVYVVNQHGKTDKLHPSVKRTPEYLPLNFETARLIGLWIAEGSTSKNGVIKFDISSNEEDLTEFITGTIRKYFPHAKIVVKDHERNRRTVRFCNKRFAEWLRENIGHGADNKSIPPLLLLNKNREVRLGLLRGLIEGDGYVRRESQRRANYISYSTVSPSLAYQLQLLVASLGYTSSIHRSIRTEGIGKTRKPIYDVKVSGKSYYSLLEELGFEVPQRGNRTYNVNRTWKNYLLLKVRSIEEEEYEGDVYNLEVEGDESGSVGFIVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 282 - protein, 900 aa, Artificial Sequence
  Synthetic construct intein-modified proSavinase_S135:Tko_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLLPDEKVILPEHGPITLKGLFDLAKETVVADNEKEIRKLGAKLTIVGEDGRLRVLESPYVWKVRHRGKMLRVKLKNWHSVSVTPEHPFLTTRGWVRADQLKPGDYVAVPRVIHGNESDERFVSFVYEKLKNDELIAKLRGEVLSKISSEFKGDRAYKVERNVFRWEDIERLNLWDEVERVAFTPRMHRSGKPLHYVKLPRSPEEWEAFFYFAGVMFGDGSQDKIANNDVEVYEELKKLSVLGVAVKRVERTTSYEIELTNGKNALLRLLRVLFEYPERQKAKSIRVPRILFIAPRKYVSRFLRGYFDADGHVSLKDARIEVTSASQEFLEDLSLLLLRFGIVSKIYRSDYTTLVISGRRNLDLFRRYIGFSVKNKAEALEKAIKKSRRSESYPIFEELKRLRLLFGFTRTELNSNVPFYGKYESEEAPSYETLMRILDAIEKGSINLDKKIAVLEGRIRDHNYIKAFEKDGLIKDGKLTELGRELLEVWRNREFDSSDVDYIRNLAENLVFIPVEDIEEFEYEGYVYDVTTETHNFVANGILVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 283 - protein, 879 aa, Artificial Sequence
  Synthetic construct intein-modified proSavinase_S135:Tko_LHR
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVSGDSKILTGKGPVEIGRLNSNMIAGIWRFQTELVRFEEPHRVEYRREGVKIRTRLGFEIKATKEHKFLTVDENGELRWVEAWKLKEGNWVGVVRRLPSPNVKVSILDLLPPNAYLKLKGEFLRELKLSIQAKFGSIRTYAKKKRWSESYLVKQLNGVYPFRWERLSAVLKDLDLRMTENDVERITSDKGKYSLPIEFTPSMARLLGFWMADGSWKGGTLTLFSSDRKMLEKYKELCKEEFGVVGRIRMLNESTYSLEISFNLLPAIFKNLTGNTERKSKLGTFPSIIYSLPEEHKREFLAGYFDGDGFLEVKGGRVYSAGFSTFNKRFAEGIRDILLQLGIVSSIRAREYDEVQKFKGRVIPKKGASYTVSVLGGEYLKRFFDAVRPWRSDYEGWEGMYNEGYSNSDVVPNLGKRLRSIRERLGISAYRMSKMGFYNPVRVELGEREISRRNLRLLVEFYERVAKEKRVEDVLEELSYLRELAEGDVFFDRITSVEPAYIDVAYGIINSETENYIVEGFISKNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 284 - protein, 890 aa, Artificial Sequence
  Synthetic construct intein-modified proSavinase_S135:Tko_Pol-2_Pko_Pol-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLELPERNHVLNLVELLLGTPEEETLDIVMTIPVKGKKNFFKGMLRTLRWIFGEEKRPRTARRYLRHLEDLGYVRLKKIGYEVLDWDSLKNYRRLYEALVENVRYNGNKREYLVEFNSIRDAVGIMPLKELKEWKIGTLNGFRMRKLIEVDESLAKLLGYYVSEGYARKQRNPKNGWSYSVKLYNEDPEVLDDMERLASRFFGKVRRGRNYVEIPKKIGYLLFENMCGVLAENKRIPEFVFTSPKGVRLAFLEGYSSAMATSTEQETQALNEKRALANQLVLLLNSVGVSAVKLGHDSGVYRVYINEELPFVKLDKKKNAYYSHVIPKEVLSEVFGKVFQKNVSPQTFRKMVEDGRLDPEKAQRLSWLIEGDVVLDRVESVDVEDYDGYVYDLSVEDNENFLVGFGLVYAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 285 - protein, 836 aa, Artificial Sequence
  Synthetic construct intein-modified proSavinase_S135:Tko_RadA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 286 - protein, 843 aa, Artificial Sequence
  Synthetic construct intein-modified proSavinase_S135:Tko_r-Gyr
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTPDTLVSLADGRIMEIKDAVEKSEGNLLSVNGLKPKEAKALKFWEIDWNGPLKVIKLKNGHEIKATPDHGLLVMREGKLGWVSAKNVREGDYVAFAYNTGHRGRDEYTLLKLMIKLGITDVMVELDEEYFNEKVAPIVRERISTSTKYKYLRRRVLPLYLLQEWGLDDYEAHVKSLYRQRAGSKPIPNFKLDGRFWYVFGLVLGDGTLRDSKVLISQTPLKDVKSVLEDVFPFLRVFETTNQVGFSNSIIAEVFRRLGARKGKLHPLVFGLREEYINAMIAGYFDTDGTFSILNDRKGPNFRGILTSKRGDVLRMLSVYLYQIGIMNYLRRDERTGVWDLIISNRSLEKFREKIYPYLRIRRAQFDEAYSVYRASRRAFEGDLLPVAPVFGKLKFKNGTKNRILKETGIDVWNWLKRPEGEIPRDKLSKVLEYAEESPEKEFLKSLVEAGVTWVKVKGVEEELYTGKLYDFTTTTENFLSNGAVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 287 - protein, 808 aa, Artificial Sequence
  Synthetic construct intein-modified proSavinase_S135:Tko_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCIDGNAKIIFENDGEEHIMTMAEMYERYKDLGEFYDPEYNRWGINVEEVPVYVKSFDPSTKEITKGKVKVIWKYELGEDVPKYEIKTNKGTRVLTSPWHPFFVITQDLKIVEKRADELREGDMLVGGMPSDDDYEFLLDYWLAGFIAGDGSIDKYRSHVKGHEYVYDRLRIYDYTTETLGIINDHLEKTFGKRYSLQRDRNIHYIDIKAKGITSHYIELLRGITNGIPQPILKEGRNAVLSFITGLFDAEGHVNSKPGVELGMVNRKLIEDITYYLNSLGIKARMRKKPRKDGVDYVMHVEEYSSLLRFYELIGKNLQNSEKRIKLEELLSKHNGGSFGLTLSFEDFKAWSSKYGVEFKTNGSQTLAIIKNEKVSLGQWHRRGRVSKAVLVKMLRKLYDTTKSEDVKRMLHLIEGLEVVKEINVTNEPKTFYDLTVERYQNYLAGENGMVFVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 288 - protein, 865 aa, Artificial Sequence
  Synthetic construct intein-modified proSavinase_S135:Tko_TopA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLHPDSLIPTPQGVKRIKELPEKGEVFALDFDLKLSRARYRLLERDADEPMYKVTLSDRTELYLTADHPVLVYRDDQLIFVPAEELRENDQVVLFINRSEYSPRTESPTLLGFLLENATSMKDYILYDPEFGGVLRNRIKDAGLKTEILWRFRIREPTYYKYLRGKMPVPIVRFLLEEGVVSIEELREVFRGFSYSTSLTPISFEFSEEFWYLFGLVAGDGHLAKKGAITIPAKDRTEDTVKAVKEIANSLQVPFAFDEKYKMIILRSKSLTRLFELLGCPYGNKTEIFRIPGEIMAKPEWMAAFLAGYYDADGHIGTKPTGGKKSHSPQIVLTSKNRMAIYTVKQMWQLLGVGTYLWEKKDRNGNFMAYELKVYSRDAWRFYEVMKNHLRIKRKDLEHVKEVAIRKRKAYSHHYSVLNVKSWEGKIKSSNVLWKKFDMSNQTAHGRGISLDKLQRIVDYLTDTDLRRIAMGDVYVLGIRSIEKFHYRGKVYDLVVDQYHNFIANGVVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 289 - protein, 777 aa, Artificial Sequence
  Synthetic construct intein-modified proSavinase_S135:Tth-HB27_DnaE-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTGDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 290 - protein, 792 aa, Artificial Sequence
  Synthetic construct intein-modified proSavinase_S135:Tth-HB27_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYGVRVVTAKGLERYLERIGVPKGSRLEALHGIKPDVRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 291 - protein, 761 aa, Artificial Sequence
  Synthetic construct intein-modified proSavinase_S135:Tth-HB27_RIR1-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGPGTLQETRSNTFHLHFNRIPAEFFQALGVKAARATEKRVPESLFRAPREAVVGFLQGLFSADGSVQINENKQDATVRLASSSLALLQDVQLLLLNLGILGKIHKRREAARKALPDGKGGLREYPVAPQYELILGGENRDRFAEVVGFLQEEKQSKLLAFLRHRPRGSYRKPFLATVASVEPAGEAPVYDLTEPVTHSLIANGLVAHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 292 - protein, 540 aa, Artificial Sequence
  Synthetic construct intein-modified proSavinase_S135:Tvo_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVSGETPVYLADGKTIKIKDLYSSERKKEDNIVEAGSGEEIIHLKDPIQIYSYVDGTIVRSRSRLLYKGKSSYLVRIETIGGRSVSVTPVHKLFVLTEKGIEEVMASNLKVGDMIAAVAESESEARDCGMSEECVMEAEVYTSLEATFDRVKSIAYEKGDFDVYDLSVPEYGRNFIGGEGLLVLHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 293 - protein, 506 aa, Artificial Sequence
  Synthetic construct intein-modified proSavinase_S135:Tvu_DnaE-n_NC-terminal
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLSGETAVMTVEYGAIPIRRLVQERLICQVYSLDPQGHLYTQPIAQWHFQGFRPVYAYQLEDGSTICATPDHRFMTTSGQMLPIEQIFREGLELWQVAIAPPGALAQGLKPAVQMSCMKIVGRRLVGWQAVYDIGLAGDHNFLLANGAIAANSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 294 - protein, 661 aa, Artificial Sequence
  Synthetic construct intein-modified proSavinase_S135:Unc-ERS_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLFDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 295 - protein, 810 aa, Artificial Sequence
  Synthetic construct intein-modified proSavinase_S135:Zba_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAKGTEVMMHDGSVKAIETIEAGEAVMGTDGQPRKVVGLPRGREVMYKVSQKTAHRVHKTDETRAAPVALFEYNCNATHKLVVRTPRSCRSITRKMQGVDYNEVIFFDLKKKKLEDGREIEIVKEVSRSYPAAEGAEKAAQMVKDYYDAARGKEFFEWTIEARDVRELGAHVRKATHQVYAPVLYESDFFFHYVKNSKFALRSEASTALAYLLGLWVGDGLSDRAVLSVDSEDSSLLERITGYADILDLSAEYKDREIPKRAKTVCLYPKTIRGNDIRRNLNTDNPVWNAIVDLGYLKDGVKNVPSYLFSDSICHREVFLAGLIDSDGHVRGDDGLSVTIKTIHKTVMEGTVAVARSLGLIVSVNTEEAKIDKNDVNHRFVYAIYISGGDALLSVLAHCAAAKKFRAPPSNEVVRGLKKVFFEMEELKEDDYYGITLAKESDHQFLLANQLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 296 - protein, 804 aa, Artificial Sequence
  Synthetic construct intein-modified proSavinase_S135:Zro_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAKGTEVMMSDGSIKEVEGIEVGQEVMGKDGKPREVVGTPSGREKMYKVSHKTAHRAHKSDSTSERFGLFEYTCNATHKLVVRTSRSCRPLVRNIQGTDYVEVCLFNMTKKTLEDGRVIDIVEETSDFYPAVEGPEKALRILKEYAEADGGKEYFEWTIEARDVALLSAQVRKATYQLSAPVLLENNHFSHYLKDSNSAVGNDTVRALSYFLGLWIGDGMLNNAATFSVDSQNASLLNRINEFAEVLGLSAEYKDSQEPKRAKTVNLYAKAIRDEGVRKNLDTHNLLWDAIVDLGYLKDDSKNVPGYICSDSFQHREVFLAGIIDSTGYVSDETATVKTIDQSVMTGTVAVARSLGINVSVDVEVDEDGVDRSFVYAIYMDRSDALLAVLANCASNNKQIEAPPHGVIREFNKAYFEMEELEEDEYYGLTLSNESDHQFLLANQLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 297 - protein, 700 aa, Artificial Sequence
  Synthetic construct intein-modified proSavinase_S317:Aae_RIR2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFIEGTEVLTKRGFVDFRELREDDLVAQYDIETGEISWTKPYAYVERDYEGSMYRLKHPKSNWEVVATEGHEFIVRNLKTGKERKEPIEKVKLHPYSAIPVAGRYTGEVEEYDLWELVSGKGITLKTRSAVKNKLTPIEKLLIVLQADGTIDSKRNGKFTGFQQLKFFFSKYRKINEFEKILNECAPYGIKWKKYERQDGIAYTVYYPNDLPIKPTKFFDEWVRLDEITEEWIREFVEELVKWDGHIPKDRNKKKVYYYSTKEKRNKDFVQALCALGGMRTVVSRERNPKAKNPVYRIWIYLEDDYINTQTMVKEEFYYKGKVYCVSVPKGNIVVRYKDSVCIAGNSTYASLNGTSMATPHVAGAAALVKQKNPSWSNVQIRNHLKNTATSLGSTNLYGSGLVNAEAATR

SEQ ID NO: 298 - protein, 507 aa, Artificial Sequence
  Synthetic construct intein-modified proSavinase_S317:Ace_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCQPYSAPVSTPDGPIPIGKLVDANAVGEKVFDASGVTRIVATTCNGRKPVLRIRTSGGHVLDVTPDHLVWQVVDQTAGRFVPAGQLRVGDRLEWHDRANSDAMVAAFTADSAAAAQPGQIVDILAIDELGVMPVYDIQTESGEYLSDGIRVHNSTYASLNGTSMATPHVAGAAALVKQKNPSWSNVQIRNHLKNTATSLGSTNLYGSGLVNAEAATR

SEQ ID NO: 299 - protein, 772 aa, Artificial Sequence
  Synthetic construct intein-modified proSavinase_S317:Aeh_DnaB-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTGDTRVLLADGQRVPIRDLVGQTPEVISVNAEGRLEPAKTDLVWSVGVRPLLQVRLASGRTIRCTPEHRLRGLWDWKEARDIRVGDRLGIARELPAPKVTKRWAEHELVLLAHLVGDGSYIKGQPLRYTTASEANSEAVSRAAEAMGSTVTRHPGRGQWHQLVISGNGNRWHPQGVGKWLKQLGVFGQRSREKHLPQEVFQLDNDQLALFLRHLWATDGSITQGSAGRPRIYFSTASRHLIQDVAALLLRFGIVGRTKHITHGDGEGWFTLDISGAVQQQRYLEKIGAFGHQAHNARRALQHLRGLVENTNVDTLPEEVFNYIRERMREEGITHRQMAALRGTAYGGSAHFTFSPSRETLLSYADILNDQRLRMLANQHVFWDRVVSVEPAGEEEVFDLTVPGNACWLADGIVSHNSTYASLNGTSMATPHVAGAAALVKQKNPSWSNVQIRNHLKNTATSLGSTNLYGSGLVNAEAATR

SEQ ID NO: 300 - protein, 959 aa, Artificial Sequence
  Synthetic construct intein-modified proSavinase_S317:Ani-FGSCA4_PRP8
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLANGTQLLRYDGTKVNVEDVKEGDLLLGPDGGPRRAFNVVSGKDRLYRIKIDGDKEDLVVTANHILVLHRAKAMNTSVCFDRSKEQQGGAGEQLDISEVSAAERYDTVEMTAAEFAALHPQERSWYRAIRCPGFELPEQDVPVNPYFLGLWLGDESRNQSAIYSNHEEALREFLVSHAAELDMHLVYHGQSAYSTVCNKDRPTNKRIGPANQTQTVRPTIRQTRRTIRQQRLAAEHAAAEYTTQRETASLTPLLESPTSDKHGLLSSVETPGRLSDSVTTELPMSRSASAMRSIRTASGLSEFNDVTNVSASMPDIQNSGIKNQGRIAKVTRQQDSKGEVDFRQQYSQAIKDDLELLETDIEDDVASSDEIEDVCVVGSENELIGSEKQDQSGRRRQIHRLRTGHRGYGDLSDDEQEQLLDSVVERYAGDSRLNTLQQELSKMGILNPETGPINDKKRIPQVFMQNSRSVRLSVLAGLLDSDGWYIYPENMFGFAQSELCHKELFWDVVTLARSLGFGVWTKKRMMPDPTGKRMSPMLVAQISGDLAEIPCVLARKKAMPRLIPQSHSFAIKDISLESEATEWAGFRVDKDQLYLRHDYVVLHNSTYASLNGTSMATPHVAGAAALVKQKNPSWSNVQIRNHLKNTATSLGSTNLYGSGLVNAEAATR

SEQ ID NO: 301 - protein, 822 aa, Artificial Sequence
  Synthetic construct intein-modified proSavinase_S317:Ape_APE0745
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSLPPWEPIVVRRGDEVRVTSIGEFVDSFLEGEGGLDIGGLGYYTLSLDTRTLKPVWRRIRGVIKHRIRGRLLRVKASKGRSIDLTGSHSIYRISRGGGLEVVGSSDLRPGDSLVTPASVELPESAPSSINAARELWSRGVEGIFVVGLPGEAAGYRGVERSRGYDGGHAIPLETLVERYGDSVWSLVSGAKLAVSRGAAGDHPVPATIPLDTGFYLLLGFIVSAGSVDVEGGHVTVTLGPGREGYVGDVVEAVNSTAPGAGVRISSGARGMEVTIRSRVLSELLARVFGAGPGPNRDIPSIVFRAPKPMKRVFLKGLYAGGGVFDRSSGSLIYATDSRSLLNGLALLLLNVGAGGYRIDSGDSGRALALIVENAGRLDAIGEVLEHLGFHGGREAVQGVGALERATAGLAGQATVAVQRPATRGGPGVDVAGVTGLEHLEASTEFVYDLSVEGDENFFAGLGWILVHNSTYASLNGTSMATPHVAGAAALVKQKNPSWSNVQIRNHLKNTATSLGSTNLYGSGLVNAEAATR

SEQ ID NO: 302 - protein, 732 aa, Artificial Sequence
  Synthetic construct intein-modified proSavinase_S317:Avin_RIR1_BIL
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAPETLVHTADGPRPIRDLQQGDLVLGISGRYREVTHKFVYNQTDAMLAIRVKHAVEPIEVTAGHPFYAIRGVPLEQSGERTLRQLESGKRSPEWIDAGELERGDYMAQVIPSEVVPVAGFDEDDARLYGILLGDGHLSKNGLQWGVSGHPQRDGHMDFVRAYLSARGIHFWETARDETYGQIHWASGRGVRRDATTGRITGAGAATLPFEHADLYDEQGRKRIARRFSHLPRQQSLALIRSLLESDGGVSRGKEIYFTNTSRPLIEGLRYQLLRLGVPTAGQYRERRQDHVGQRADGSPIRFEGVCKAYDLRIPAVPEVAQLVGCQPIAKRNWITWQGCVYSRIRDVQPIAVKPFVFDLKVEGDESYMTTSGLAHNSTYASLNGTSMATPHVAGAAALVKQKNPSWSNVQIRNHLKNTATSLGSTNLYGSGLVNAEAATR

SEQ ID NO: 303 - protein, 842 aa, Artificial Sequence
  Synthetic construct intein-modified proSavinase_S317:Bde-JEL197_RPB2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLSGDTEVVLGNGMDVVLLTDLVDGACVSTIEPRTGVVSPSLIDHYFAKDATRVLKITLDDGRVIKADPEHPLFAAKVDETTRGLTGQWLRVEELTVGHHALLVSPQQAYCTSEQWTLTLSEKEVCTASTAQLAKQLSEIGLVGVPIPLSKVKSAARLFGLVLSAGDFSGKLYVEKDEDVTAVNSDLTALGFSPAHWVRYQDDQQKWFKCDDSNGKAICITLVPTANALLQTLGAHDAEKQHRYCLLPKWLLDAPTSIKREFLGALFGGNGAHITISCNEGKWEPTMSALTQHTDADHLESTVVYLKQVATLLGMLNICSSVSSEKHITAEKTGYAVHLHVDNTAENLVRFYEQVGYRYCFNKTSQSSAPVQWIKGSLFFIEQHRSKCQHAFELLHTGLGTKAAVSAEINMPHHNPSHMLNVKEIPTAPADEYITWIEFKDRYVHKESPRFVWVTIHSIEEAPAERLYDFNTVSQNHSFFANSIVSHNSTYASLNGTSMATPHVAGAAALVKQKNPSWSNVQIRNHLKNTATSLGSTNLYGSGLVNAEAATR

SEQ ID NO: 304 - protein, 773 aa, Artificial Sequence
  Synthetic construct intein-modified proSavinase_S317:Bde-JEL423_eIF-5B
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFGRDTPLLMADGTTKFVQDIKALDQLMGDDCTPRIVQERSLVHESGALYRVVPKNANGHDAFVCNKEHILVMVNVKQPWVSQTVIDGVDQFHVSEVVCIGNIPTVRSSGNFASAVEATKALPAWTLLIWEISVLEYLAVDADLRQHFMIYKPAGGIEYPTTTNLDIVQHFGAESVPNLEHAVMWCIGLWILLGDVDTAGNPVLILSGIDHLHPLIKTLHSHSQKLSISFTNQLDEGVADISKPTIIALGDKFGLLFKSLGIESAECIPDALLRSSKLHRAALLAGLVEGSNAFSIVKDTPKHWDISCKNNMIFENIKRLSSSLGLCVDTVTPATITQQVSVKTLQIRISGPRMHYVSELISNDSLKTTSVVSIDSWLNVKSNACEFEIESIGCGEYFGFTVMGPNSRFLLGDFTVTHNSTYASLNGTSMATPHVAGAAALVKQKNPSWSNVQIRNHLKNTATSLGSTNLYGSGLVNAEAATR

SEQ ID NO: 305 - protein, 739 aa, Artificial Sequence
  Synthetic construct intein-modified proSavinase_S317:BsuP-M1918_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTGETLLLTENGYEKAADLYKKQNNLKVVIDNRTKDFAVDSKGTTIVDAIPMQLTKKDAEIFKVKTKQGYEIRATEWHKFYVKRDGEIQKLQLNQLKTGDKLLVQSAEGAYGKIHEPDLAYIMGIIAGDGTITEKTAKIYLYDNKKVLEQKVTDAVHRIIHKHKVDRAYKHNTSLLPTFNMANPEKQDLLYMNSTVLFDILKKFGMNKERKTRVPEFIFQANKETQAAYLSGLFQTDGCVNANHKAKALTIELTSIHYESLQDVQKLLLNMGVYTTIYSNNKRSQELLPDGKGGSKLYNVKPTHKISIQDRNSRELFMSIVELKDYDVYKFNLLTETLQPKSRKPKHDFTAEIISIEEDGVEDVYDTTQEDYHSLIFNGIVTGNSTYASLNGTSMATPHVAGAAALVKQKNPSWSNVQIRNHLKNTATSLGSTNLYGSGLVNAEAATR

SEQ ID NO: 306 - protein, 724 aa, Artificial Sequence
  Synthetic construct intein-modified proSavinase_S317:Cag_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTADTLIATDRGLERIGNIVGESRGIKSIDGKLHWVENIFPTGTKPVYQLRTKSGYQLKLTGDHVVFTENRGDVKACELRKDDMVRLVGAPFGKETTGSTDIAQLIGLLTGDGCITTANEIAASGEQRRTAFLTVSKAEQEIAEWANQFINTLRPELGEHNKSGSVTETATTARVAVGSPRILKQFEAFAVLDKGSVHKLFTDKVFQLAQSEQAALLRGLFTADGTVANYSDKSQYIALDATSLELLQQVQLLLFNFGIKSKIYENRRVGELVSLLPDGKGGIKEYPVQQMHSLRISRSSRILFEQQIGFMAESKKYEALAELNRTVSTYRDSAYDAVASLTYSGEEAVFDLTEPETDHFIANGIGVHNSTYASLNGTSMATPHVAGAAALVKQKNPSWSNVQIRNHLKNTATSLGSTNLYGSGLVNAEAATR

SEQ ID NO: 307 - protein, 630 aa, Artificial Sequence
  Synthetic construct intein-modified proSavinase_S317:Cau_SpoVR
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLHGDSLIVTDHGLVPMREVVNHRQRLQVSDGERQQTVYDWNRFADYPTVTMRTRAGFTLTGSHNHRIMLADGTWRRLDELQIGDRVRIAGGTELWATEPALLRCRRPLPRVLVTAGAPAATTSSPHRRGYRRAAAVVVDEKLAAAIGRRCVTHADQQALDAIRRSPRPQVVAFLRAFCQGAGQSVASGLTLTCADADLATTVQLLLTNLGVLAHRTDTTVRIDNGDDLERAYTTLATPTGWTDEVVALEHGTADVYDISVTATHRYAAQGFINHNSTYASLNGTSMATPHVAGAAALVKQKNPSWSNVQIRNHLKNTATSLGSTNLYGSGLVNAEAATR

SEQ ID NO: 308 - protein, 500 aa, Artificial Sequence
  Synthetic construct intein-modified proSavinase_S317:Cbu_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTGDTLICLADGRRVPIQDLVGHSPEVIAVDDKGRLVCAKSEVIWKVGERSVFEIKLASGRSIKATAEHRLLAFKGWRHVKDFKVGDRLAIAHQVPEPDRLLQHCQSDLFWDRIVSIEEKGSEEVYDLTVPKYASWLADGVVSHNSTYASLNGTSMATPHVAGAAALVKQKNPSWSNVQIRNHLKNTATSLGSTNLYGSGLVNAEAATR

SEQ ID NO: 309 - protein, 810 aa, Artificial Sequence
  Synthetic construct intein-modified proSavinase_S317:Ceu_ClpP
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTSDHTVLTTRGWIPIADVTLDDKVAVLDNNTGEMSYQNPQKVHKYDYEGPMYEVKTAGVDLFVTPNHRMYVNTTNNTTNQNYNLVEASSIFGKKVRYKNDAIWNKTDYQFILPETATLTGHTNKISSTPAIQPEMNAWLTFFGLWIANGHTTKIAEKTAENNQQKQRYKVILTQVKEDVCDIIEQTLNKLGFNFIRSGKDYTIENKQLWSYLNPFDNGALNKYLPDWVWELSSQQCKILLNSLCLGNCLFTKNDDTLHYFSTSERFANDVSRLALHAGTTSTIQLEAAPSNLYDTIIGLPVEVNTTLWRVIINQSSFYSYSTDKSSALNLSNNVACYVNAQSALTLEQNSQKINKNTLVLTKNNVKSQTMHSQRAERVDTALLTQKELDNSLNHEILINKNPGTSQLECVVNPEVNNTSTNDRFVYYKGPVYCLTGPNNVFYVQRNGKAVWTGNSTYASLNGTSMATPHVAGAAALVKQKNPSWSNVQIRNHLKNTATSLGSTNLYGSGLVNAEAATR

SEQ ID NO: 310 - protein, 699 aa, Artificial Sequence
  Synthetic construct intein-modified proSavinase_S317:Chy_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTGDTLVFTDKGLIEARKLEVGMKVWSGDGWNEIKEVINNGVKPVLKLKLKTGLEIKVTEEHKIFTGEGWKEAKDLKVGDKLYLPVSYPELDFPVKEENDFYEFLGYFLGDGSLSVSNHVSLHVGNDKELALYFKEKVEKYAGAAYLIERDGQYIIDVHRKEFAEKIKKIFGIEITDSKEKDIPSSLLAVNSEAMKALLRGLFSADGSVYDANGSITVALSSTSYPLLRKVQILLLSLGIPSTLTGEKDQDVKIIKGNEYETLPTYRLIISGERASLFFNKIGLIGEKKKKFLELMAGKTTYSTLNNHLYQEIVSIEPAGEEEVFDITAPPKYTWITNGILSLDSTYASLNGTSMATPHVAGAAALVKQKNPSWSNVQIRNHLKNTATSLGSTNLYGSGLVNAEAATR

SEQ ID NO: 311 - protein, 489 aa, Artificial Sequence
  Synthetic construct intein-modified proSavinase_S317:Cth_ATPase_BIL
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFVAGTMILTVAGLVAIENIKAGDKVIATNPETFEVAEKTVLETYVRETTELLHLTINGDVIKTTFEHLFYAKDVGFVEAKELQVGDKLLDSKGNVLVVEDKKIKITDEPVKVYNFQVDDFHTYHVGCNGVLVHNSTYASLNGTSMATPHVAGAAALVKQKNPSWSNVQIRNHLKNTATSLGSTNLYGSGLVNAEAATR

SEQ ID NO: 312 - protein, 687 aa, Artificial Sequence
  Synthetic construct intein-modified proSavinase_S317:Cth_TerA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGQLALDTPIPTPDGWTTMGEIKAGDKVIDEKGRPCNVVAISEIDDTEQAYKINFRDGTSIVAGERHLWKVQVTNNGRREKLLTTGEMYQKQFKTKSKENRALFRIPIADAFILPENKLPIDPYLFGYWIGNGNAVKPEITVMRDDVDEVIKNIPYKLHNRYKQEGNSDILVYKELKSILVKNFREKRIPIEYLRASAQQRKRLLQGLIDSDGCVSTAKSQAIYVTILFELAKDVQDLLWSLGIKNTLKTAPSARYGIETGEICYLIKFTAFNDLEVSGLDRKLKRGRERNIKTRSHFHYIKSIEKTGKTKMRCIQVDSPSRLYLAGKSMIPTHNSTYASLNGTSMATPHVAGAAALVKQKNPSWSNVQIRNHLKNTATSLGSTNLYGSGLVNAEAATR

SEQ ID NO: 313 - protein, 690 aa, Artificial Sequence
  Synthetic construct intein-modified proSavinase_S317:CV-NY2A_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVAGDTKILTSSGYHPIKDMEGKQVRVWNGYEFSETIVHKTGVNQKLIMVSLDDGTELRCTPYHKFYIETGSRPADKSRVMEVRAGDLEKGDRIIRFELPTITVGETTMSDKEAYTKGFFSADGCVIKSKYGEDEYRISVKREDKIEALTKYVDVIKSHTNRFRTHFYVPDYVQNKFEVPINSMVNEKISWLAGFMDGDGCVIRYKDIENMQAVSINKSFLQDIRLMLQTIGIHSTINKFMPNRVMKMPDGRGGTDMYNGAESWRLQIDSEGVRKLFALGFTPRRLKMNGSRKRHHKTNKFTRVVSVTDHGDVEDTYCFNEPKRHMGVFNGVITGQSTYASLNGTSMATPHVAGAAALVKQKNPSWSNVQIRNHLKNTATSLGSTNLYGSGLVNAEAATR

SEQ ID NO: 314 - protein, 748 aa, Artificial Sequence
  Synthetic construct intein-modified proSavinase_S317:Cwa_PEP
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFDGKTKILTNQGFMTLRQVYEQGYEGLSTLSLNTKTHKIEWKPILDTMKRQSEMIDISVSQTGRITDNTLRLTPDHKMVNLRGGKYTKTEIQDLLKQQEMLTVAQTIPSLGNNKHQEADLAYFLGGIITDGSIYTSSTRGEVQFIQKDVPEKQAFISKMNDLANSLYGKSFTAHIKPVSSSYIRGQKVTGQATAYRLHSKAIAYDVKERENNITQLLLENEAELSYHFLGGVIDGDGCYHKNRLHIYISEENLLQAVIIACLKMNTVPQVTKNRNIYHLQIVEKLEVILRYTQRVKGEVTPRTIQTRFFATRQLFENQETGQIKLRQDNNCLISDKQLREMGEFEELIDGDTRMQRVIQVGEKSDGDVYNITVAEHHNYVVFTAKYTPVVVCNSTYASLNGTSMATPHVAGAAALVKQKNPSWSNVQIRNHLKNTATSLGSTNLYGSGLVNAEAATR

SEQ ID NO: 315 - protein, 701 aa, Artificial Sequence
  Synthetic construct intein-modified proSavinase_S317:Cwa_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVAPETKILTDRGQIAIADVAGEKVNIWNGSEWSEVLVKKTGENQPLLKVHFSNGESLDCTYYHKFHVQENYKGKVKIVEAKDLQEGDKLIKYRLPLVESENDIDFPYAYTSGFFSGDGSHDGMGKPEIDLYGEKKELLPFVTVRNKYYGGSYGDKSWRIERDEVAVYDDVNQDRIVCKLPLDIPAKFTVPVNGYTIQSRLEWLAGLLDADGTVARNGDNESLQVASTHQQFLLDIRLMLQTLGVDSKVVKMDEMGYRSLPDGKGGYQDYFCQAKYRLLISSNGLFQLGELGLKTNRLQWNLREPQREASQFIRVEKVELTCRYDDTYCFSEPKRHLGMFNGILTGQSTYASLNGTSMATPHVAGAAALVKQKNPSWSNVQIRNHLKNTATSLGSTNLYGSGLVNAEAATR

SEQ ID NO: 316 - protein, 961 aa, Artificial Sequence
  Synthetic construct intein-modified proSavinase_S317:Dhan_GLT1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLASDTLVRTSEGDKPVAEVAIGDYLLDAEDKPVLCMGANPSQTGRMKEIAYQDFDSKKRVSFKCTPDHHLELTLTDSTPSLSGKSVTWFSRCTGAHLSEEVSEVYLDNMVSIFYNDLVDSTDSAVDKDSIHEAVDLALEDHYHRGNSDQYSIHLNEYISRIADKELQNEPEFIRECIHDAANRFVITSSGNRNIKSESFDDKLLLSRSRSSTADSDSDYVITDASVHSHSNNSSVYLASPDSMIPDGAANRFENIASKLKEPVCNCGGIRKIFRSFGTTEDAELAYSLLLSEHYYRLDPRFVTDGYTFQASVEQYENMCSQEVQNMHLKLYRSPLKFVEREHNSAELPVDPYFLGLWLGDGDSSGTTIMTTDREIVVWLNSYVERLNQNKPEGCFPLKLTEQLIYGAGHTSKSGHTTKVDVRNYKISSGDAFVRSGTYWNPIFDGLKKLGLLNNKSAGIPQEYMNSDEQNRLSVIAGLMDSDGCYVKSHNTYRFTQLTEDHKKIVYDLKELALSCGINTTGVELSVKPLGFNKHKHSTEYVVYLGNGSQKFQELLLLPRKKMEISKKHVSLDARPFTVSDVEDGEFRAIEVSGGVFQLANRLVVANSTYASLNGTSMATPHVAGAAALVKQKNPSWSNVQIRNHLKNTATSLGSTNLYGSGLVNAEAATR

SEQ ID NO: 317 - protein, 648 aa, Artificial Sequence
  Synthetic construct intein-modified proSavinase_S317:Fsp-CcI3_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCQPYDALVSTPSGLVPIGALVETDAVGMKVFDAHGLTQVIATKSNGVKDVLRIWTRAGHALDVTADHLVWRSTSAGAGAFVPAGALRAGDTLEWHRTIAPGEGEITSREIAEAALAGRLQADGFVGRYAGTNASLTIEAMTVPTRLYDAPLPVVAAYLRSLFQADGYVSRRERSTLIGLDMISEGLIRGVQGLLARFGIFARVRREADPRPDRHDLWSLGIQNAGDRRTFADEIGFLDPVKAAKLEASFDQPGQAAKPVKRLQIERIEPRGPMPVYDIQTDSGEYLSAGLRVHNSTYASLNGTSMATPHVAGAAALVKQKNPSWSNVQIRNHLKNTATSLGSTNLYGSGLVNAEAATR

SEQ ID NO: 318 - protein, 800 aa, Artificial Sequence
  Synthetic construct intein-modified proSavinase_S317:Gob_DnaE
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVVAGTEVTDAETGAVVTVGELFESRRAVTVHALGADSKLRPRPVTDVVWNGRKRVYRLTTELGKSITATDNHPFRVLDGWKNLGELKPGDRIAAPRRLAVPSAGTWPQHEIVALAGLLSEGNTCHPTTLYFYGNDRVLIDDFARAIGQFPDTVAKVYARPNRRNLEVRANTGRDTRLKSRAERDAAVALLAPPTRSGAFVWAQRLGILGKTATEKFVPHDVFRLCDSDLELFLGRLWAGDGFIANDTLKVPFYATSSRRLAQDVQHLLLRLGIVGRIHEKQFKYKGGLKPGFTVHLIGDGAAEAFLDRIAPHCLGREHAVTILREHVATTARGLTSKDTVPLEVRAWVDDGRRARGLTWDELEQQSDVSTQEFYGTPAPGKKGFRRATIAKLAAFFGSQRLAAVADSDVFWDRVVSIEYAGVQDTYDLTVDEDHNFVANGLIVHNSTYASLNGTSMATPHVAGAAALVKQKNPSWSNVQIRNHLKNTATSLGSTNLYGSGLVNAEAATR

SEQ ID NO: 319 - protein, 641 aa, Artificial Sequence
  Synthetic construct intein-modified proSavinase_S317:Gob_Hyp
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCQPAGTQVAKVIKEGRWREDSVIEQVPIESLQPGDRVVSFGNAKIYRRGRAVTGITSRRHTGNLHRVEVGEFRTRATPEHRFTVRFDPARPKAGLLYLMRRGDRWRVGVCGMFNSRGFGVSVRLSQERGDAAWVLGAFATLTEARIAEQVVSCRYGIPTTVWETGRNPGASWAQRDQAGIDAIYQRLGVDRIRAGVDRLLRDHGLSAGLPLLAANEPGNFSCRQSRQVAACNLVPGVMQVPVPTAGERFEWRDLTATSFERVHDLEVWSMDVERDKHYVADGIVVHNSTYASLNGTSMATPHVAGAAALVKQKNPSWSNVQIRNHLKNTATSLGSTNLYGSGLVNAEAATR

SEQ ID NO: 320 - protein, 766 aa, Artificial Sequence
  Synthetic construct intein-modified proSavinase_S317:Gvi_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAAGTLLHTEQGYVPVEQVVAGVGTRVCTHQGFRNISERFDNGEAEVFRVTTRKGYSVEVTANHKMARLDENGDLLLDELSHLQVGDNLLLLLGSNPVTEKVRLQCIPAGYRSSIEIAQPPELDEQLAYLLGYAYGDGCVGRGATYNYLSLAVSHTYPNVRDQLAAIIREKFGLTTKIYSGSGAVWNLLVHSANLLDWLKANGLLKQKAADLAMPEAILRSPSSVVGAFLSGYFDADGCVRGGKGGYGFDCTSKAFVGAVQLLLLAEGIVSNLHTTDRSRQGWRTIYRLNVCGTEFKRRFQTLCCRSAKVVHSPMVLGRDGTGGYPPALVRGASYQRVVAVGGKHLLYTALLKVIEKTRTAGKQALAESLCQHVNYFPDPIVAIESVGTQRVYDIEVEGMHLLGNGIYTSNSTYASLNGTSMATPHVAGAAALVKQKNPSWSNVQIRNHLKNTATSLGSTNLYGSGLVNAEAATR

SEQ ID NO: 321 - protein, 846 aa, Artificial Sequence
  Synthetic construct intein-modified proSavinase_S317:Hhal_DnaB-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAYDAEIVQADGGVKTIEQIVRERRAHLATVGADWRLTWTEPCDYVDDGHKPVFEVTTRLGRRIETTLTHPFLTVHGWQRLEDLAEGDAIGVPRQLPVFGQEPIRDCEVRLLGHLIGDGGLTGSPPRLTSGQEAMTADFLEAVDAFGGVEAKPIRASRRTQSWVVVGAAQARAAARSSFASLVDALIRRSPLTGRAIARNLGVAPATLTYWRQGVNVPDAAMVGLLAGELGVDVGELRPEPVARRNDRNPLQAWLDRLGLAGKSAHEKTVPDCVFRLPREQLARFLNRLFSSDGWVTHLASGQGQIGYTTVSEALARQIQHLLLRFGVLAKLRHRSVRYQDGRRPAWQLDITHAESILTFAEQIGILGKEQRLASVAASVRGRRRQSHTDHIPCEIWQFIDRARGEWTWAELARRAGVASSNIHAYRRGMSRQRLAAFADALGSRELRQLASSDLYWDRIASIRPLGHKQVYDLTIPETHNFIANDVCVHNSTYASLNGTSMATPHVAGAAALVKQKNPSWSNVQIRNHLKNTATSLGSTNLYGSGLVNAEAATR

SEQ ID NO: 322 - protein, 831 aa, Artificial Sequence
  Synthetic construct intein-modified proSavinase_S317:Hma_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVHGDTRVTLADGHERPIREVVESNLDDPKPVDDGVWDTVDFDVPSLQSDGTVATQNATKVWKRKAPETLYRIRTATGRELDVTPSHPLFVQSDGRFQARKAEELESGTHVAVPRKVSTNACNELDVTFRQSQAHNRIDLDLPPQWTPELARLIGYIVAEGYVEQRPDNTGYVSITNNDREVLDDAKSVLETLNLNVTERSSHEGKTARELLCSAGEFVSFLASLDETLLQSSAERRVPQDIMRASDNVVTGFIRGYIEGEGHVSTSQREITVASMSKPLLEDVRTLLVTQGITAQLQPRNNGSYRLRISGQSFHDYAEQIGFITARKTEACRQFEGTHGNTNLDIVPNLGPELRRIREALGLTQSECGLPRSTYQHYERGRRNPSRDSLESVLDAFETRLAEMNNDTPISDTARSDGGGTGSLRQDLNGLAALVEGDIAWDRIESIEPIEHDEKWVYDLEIEGTHNYLTNGVVSHNSTYASLNGTSMATPHVAGAAALVKQKNPSWSNVQIRNHLKNTATSLGSTNLYGSGLVNAEAATR

SEQ ID NO: 323 - protein, 892 aa, Artificial Sequence
  Synthetic construct intein-modified proSavinase_S317:Hma_TopA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTADSDVLVRSENGDIERQTVDSLFSDGQVVLADGDTDIAVSKETPTVLSLDEATERVSEQESTLVSERPLRDDESVRTIETSRGAVTVTDDHPMYIRQDGEVTVRPASDIEAGTDLVAARRPPDTMVEPSDETVLSWETFAADCDKHSKLYGVDCGTELAAQRAARDESQTAFAERYGSYGSAVGKYERGEKDVPVWLLGELDIRPDRIHGLNYETSFENPFPLEWSPELAQVIGCLLGDGSIHRNDDENVVDVRYHNTDEALIERFARDIERLFDIEPTVTDRPGRESHHKRKYQVDVPSAVGRVLVCVLEAVTENGTPGLPDAVRPAFVGALFDDEGHISREGKAFISNTDHTLLTGVGEMLAEMGIETKLAPDQHKLHIRGRRNLEQFLDRIPIASDEKFYRGLDALDAYDVTTRKAELLEAIRQEPKTSAALAQTLGVTRGSVNKYLRELRESGHIEKQIEGSNRSLDENRTVQYVAADFEGSVYATLRGEPSSVTVEDVERREYDGPVYDLTVSENAPNFAVNGGAVVHNSSTYASLNGTSMATPHVAGAAALVKQKNPSWSNVQIRNHLKNTATSLGSTNLYGSGLVNAEAATR

SEQ ID NO: 324 - protein, 536 aa, Artificial Sequence
  Synthetic construct intein-modified proSavinase_S317:Hsa-NRC1_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVRGDTTVALADGSEREIRDLVEANLDDPRPVDDGVWDGVDVAVPSLAADGRLVQRRATKVWKREAPETMYRVRTAAGHRLTVTPSHPLFVAGSHGPDAVRTEDLEVGQLVGVAPDGDGSGQVAPDGGVIRDAQPAPVGDAETVAWSAIESITEVEPDEEWVYDLEVEGTHSYLTDGVVSHNSTYASLNGTSMATPHVAGAAALVKQKNPSWSNVQIRNHLKNTATSLGSTNLYGSGLVNAEAATR

SEQ ID NO: 325 - protein, 791 aa, Artificial Sequence
  Synthetic construct intein-modified proSavinase_S317:Hvo_PolB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSVTGDRPVVVRDPGGTVRILPIEDLFARGTTESEVLIAADGDVVASATPGKTRRALDGWDALSVNEDGEAEWQPIAQAIRHNTDKPVVNLQHKFGESTTTRDHSYVVPGEDGLTTVSPDDVAEPYRVSGVPDVEPVEQVDVYEVLRGYEREYEDGRSVGSDNSITKRKQIHADDEYVWFGHEHHRDVDSTVKVKRFVDIDSEDGAALIRLLGAYVPEGSASTGETATSKFGASLAESDREWLAQLQRDYSRLFENTTAGIITSDRRAERTVEYQTDTGGASVTYNDETLKLQMMNELAAVFFREFAGQTSRGKRIPSFVFHLPEEKQDLFLTLLVEGDGSREFPRYTEAYAQRNFDFETTSRELAAGLSMLLTQRGQKHSLKYRDSKDSYTIRTCSTYREGRDPVLTEADHDGYVYDLSVEENENFVDGVGGIVLHNSTYASLNGTSMATPHVAGAAALVKQKNPSWSNVQIRNHLKNTATSLGSTNLYGSGLVNAEAATR

SEQ ID NO: 326 - protein, 569 aa, Artificial Sequence
  Synthetic construct intein-modified proSavinase_S317:Hwa_GyrB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFSGDTEIALASGDSITFESLVDAYERGETHYCYTIGDDGRIRIEEIMNPRVTQEDAALLAVTLDNGEVIRCTPDHEFMLRDGNYCEAQNLTDGQSLMPLYRTTTEMTETTETTETTGTAEMVKQPFAQNNWESVSQLANRYNRRHTTTDHIVETQQIQSQQQSQIETVQISERADVHNHTVISVESLTETADVYDLEVPVTHNFALASGVFVHNSTYASLNGTSMATPHVAGAAALVKQKNPSWSNVQIRNHLKNTATSLGSTNLYGSGLVNAEAATR

SEQ ID NO: 327 - protein, 563 aa, Artificial Sequence
  Synthetic construct intein-modified proSavinase_S317:Hwa_MCM-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHNSTYASLNGTSMATPHVAGAAALVKQKNPSWSNVQIRNHLKNTATSLGSTNLYGSGLVNAEAATR

SEQ ID NO: 328 - protein, 926 aa, Artificial Sequence
  Synthetic construct intein-modified proSavinase_S317:Hwa_MCM-4
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSYHPRSEVLLADGQRIDIGTFVDSRIEKNNANVIDGINCEILPVDDIDVYTVDTDTGSASTVSIDRVSRHPAPSEFIRVKFSNGRSVLVTPEHPMFIDDGSETKTVQANALSGGEFVPAPHHLPGVNTDASSVSDDINDVSTIRTHVRSRARAKAEVEVRATDGEFKLIDAAQTLGIITAVGKVSVDAPERGIIVDMDRTVDSSKDSINNVLGSVIPSNDNDSITRVQDTGSTGNQWRWSVNTFIERMIEIAPAVTADRPNRRVPDAVLGGSEAVVQQFLTGVIIAAGRILDETIRIYASSNELACDYADAFLRLGITASVEDGPAEIAAQTVIKCDSDYERACGMFDISSSRTTPSDTSSQNNQSSVTAQNEDTHQTTSHEILPSGIADELQSIRQLLNIPASEQLASITAGDDGIALSIARAEINLLRDHIETLRMDTENVSIGRDDCVTPTISSSSKYKYAKNSITSDENLQLFGQSQAQLSERTKTTESSSISASTDLVSIPANISENRLVAATQRLDEVETRCNRRYHRVIAVDTVSNAGPHACEWVYDITVEPTNTFISSGVVLHNSTYASLNGTSMATPHVAGAAALVKQKNPSWSNVQIRNHLKNTATSLGSTNLYGSGLVNAEAATR

SEQ ID NO: 329 - protein, 712 aa, Artificial Sequence
  Synthetic construct intein-modified proSavinase_S317:Hwa_PolB-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFTPDTNVLTPNGVRNIRDLTVGDSVYSLNPETMQMEIKPVTQTHEYPDYQGDLIDIQTNEIDFRVTPNHRMLVEATGTDTTSTNDYDFIEAGNLDISSRYELPHGWSVDHTDSLGAYIDLITLLREQSDTYNVLSDGGMTTAATADINHNNVTRRVDSDTFVSLIGWYVATGRVSRTQNGSDRVYLQLSQTNTKARTQLTMLLDELGVDWQADNEKIHFVSHVWTELFDTTCGRTEKNKHIPELIFDASASQKRAFFDAIINGSGVKNDDSYQYHTSSEDLRDDILRLCVHIGIVARYDYINDESWRIECTETANPDFTLTHSGRQSTAEDGVYCVTVADNQTLLAGRNGTFQWTGNSTYASLNGTSMATPHVAGAAALVKQKNPSWSNVQIRNHLKNTATSLGSTNLYGSGLVNAEAATR

SEQ ID NO: 330 - protein, 883 aa, Artificial Sequence
  Synthetic construct intein-modified proSavinase_S317:Hwa_Pol-II-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFHPETKIWFRDTDNEWHHETIQTFVEDRLDDPEIDAVGTLVQEVDDNTDREISVPSIDDNGNERLQSVTAVSKHRAPNHLVQIETISGREITITPDHEMHIFEQGNLVSKQASKITSGEYAVIPKRLQTISPSSHTPQHDLLREFLTRDELTADRLIIHTSDPVRLCNRVFPEEVTSCKDAVEIMQNTACHLDKNKETLIGWLGEGRIPVALLRGFVETDEALLMSIPDDVQIGLRGEKVRIDRHIGFTEELTSLLGYYAAAGIVHTQTNPISYESAQQEQSRITFYNIDTQTQTDLLNALNSVFEIEPIQYNLDGEILGVPGELIRRVFDTVFDVGTQPSHKRIPQALFDASESHITSYLRCFFSTHDSLTTDTRDISATTVSREFKEDIIAALRRLGITAEVTTQQSRSVPEVLPDWYAIDDITHHDADNSLNLTRSYVISIASSDAVTLQRDRQAQEQIKYDAQGLIANNNAIHQSRQVTDGGRKDYITEPITDIEYVDADIDYTYCLTVSETHSLIVNDLSQKQSTYASLNGTSMATPHVAGAAALVKQKNPSWSNVQIRNHLKNTATSLGSTNLYGSGLVNAEAATR

SEQ ID NO: 331 - protein, 898 aa, Artificial Sequence
  Synthetic construct intein-modified proSavinase_S317:Hwa_Pol-II-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSVAADSRLVAVSPDDKIVFTTIEDFWKKLNTPIERNGKFRKRTCVSEGWQTYAFDENHEASLRPIEKAIRYTADESEQLRRITTQLGRSLDITDEHSLFRYDDGIEEVAGDDLTAGDIIVAPRTLDVEVTQTTLDLSEYIHDNERCPSEQTGSGELNLASKSAISDSRNKETPGVTHNILPQRSKFTDEMTTLSPTAVGGLESEQNETLRVGESTGAIERYINVDDSFGWLLGQFIAQRSISTDALTMTVHTAAEKHAERIVATSDSVFGIKPTVNSIERGYEIVFPSVFDTIVSGLTAKEQSEPEQDVDHTHTDEIGIPECILHAPDDIVLSFLQGFILAENAQRKGNAASEASEMVSESETTVTLETPSVGVKDGLVFLCHRLGVITDISEKSGEEYSVHFEESRYTVSIATEGKTNPLDQILNGERPTMPEGVSVPVPDALLTIHESIANSPHIDQVIPDTVVQQETVSLETLQSLLTGLSTVDLPAQLEAKRDELTLLTEGDLSYLRVESVECVDYDGYLYDLQVGGEPVFTANWLYAHNSTYASLNGTSMATPHVAGAAALVKQKNPSWSNVQIRNHLKNTATSLGSTNLYGSGLVNAEAATR

SEQ ID NO: 332 - protein, 762 aa, Artificial Sequence
  Synthetic construct intein-modified proSavinase_S317:Hwa_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTADSTVMLKEKGMVSVSEVETGDQIAQRSDTGFQYKPVEETHAYENAETLTVTLTNGCSIRGTPNHRLMVDDEWTRIDEIQPDQEVHYTLGWLRETNQSPPKLHSQSHTTVNQTADSISPDSSEPIELSESENADTGNRHNSAVAVKQSRTQTQLISDEVVSRPEHTRRPDQLSEELAELLGLWIDTGLWHQSGVQFNVERENIAEYIDQLSQQLFDTPAAISDTDGTYTVDITDHKLKEWWKANFGGKPDGTQSSYVPQMIKEAPTNVIEAFLRGCFTAEGGLRKDMRPRLCTSSEDSIDDIAVLMMGLGYPVEKSVIRNADGEPYYSVMPATDDGLSAFLHDVGFIDERREIGLSNIESSDSRALNNTHKIEVESIVESPPATVYDITVADNHEYVTDGIISHNSTYASLNGTSMATPHVAGAAALVKQKNPSWSNVQIRNHLKNTATSLGSTNLYGSGLVNAEAATR

SEQ ID NO: 333 - protein, 792 aa, Artificial Sequence
  Synthetic construct intein-modified proSavinase_S317:Hwa_RIR1-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVEENSLVSTDEGLRPIKDLDNTTAEFEQWDEIDVGVTTDGGTKTATAVYDNGFANVRQIQTESGFNIAATPNHRFRTLSSDGTYTWKEAGKFESGDRVILQRNTFDAGSRVSLEANERADDAQDTTEGPELPGRMTSELAEFLGYFMGSGYISDETHASVDLVVDSDATELNSYLSNLGEQLFRITPAVESQEMSQVLSFRDCHLSRYFEDNGWKKTDTGHNGDASAAFVPEQILEGDEQVVNGFLRGVFEAIGTVSEKIEILTTSTTLADQLQSLLLSLGHVFTRDSTKLVETNNYHDDQLRQRLCGATRREDERFMNEIGSLIEPDELNLSTRADKNDTYPSSVIDHVQTLDGYDSVSESLKSRINQSQVDGTVSRKLIKDIEAETAETVSIADHELTGFYAATVESVTEDTAYTKDISVPSNNTYIADGFVTHNSTYASLNGTSMATPHVAGAAALVKQKNPSWSNVQIRNHLKNTATSLGSTNLYGSGLVNAEAATR

SEQ ID NO: 334 - protein, 568 aa, Artificial Sequence
  Synthetic construct intein-modified proSavinase_S317:Hwa_rPol_App
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSIEADESIVIRRDGETELTEIGSFVDTILAADNQETRITDGHEIALAPNGLEVPSLDTDEQIRWKHIEAVSRHASPDEILLIELESGRSIRATKAHSFVTRRDGDVLPVAGETLVVGDVLPTVGSYDHASGSISVPLQSQSVAADGGTVEPNTNITANAERDSASITSAGIIGSATWERISSIETVAPEYEYVYDLSVSGLETFTTGEGVVTHNSTYASLNGTSMATPHVAGAAALVKQKNPSWSNVQIRNHLKNTATSLGSTNLYGSGLVNAEAATR

SEQ ID NO: 335 - protein, 782 aa, Artificial Sequence
  Synthetic construct intein-modified proSavinase_S317:Kra_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTAGTRVLRADTGAETTMGELFALQARDVPVWSLDESLRYVRRHLTRVFPTGVKPVFRLRTASGKTVRATANHPFLTYDGWKPLGELSVADRLAVPRHVPAPERVASWTDDQVLLLGHLIGDGSFVKRQPLRYASVDEANLSAVTEAAANAFSIVAVRDEYAAARCTTLRLPAPYRLTHGRRNPLAAWLDELGLFGLRSYEKFVPQEVFHLPKRQIALFLRHLWATDGSVTLTRQSRGGRIYYASTSLQLIQDVSRLLLRFGISTRVRTTTPKGDHRPGYTLDVSGVDDQRRFLQEIGVHGARGATADRLLEVIRDVSANTNVDTVPRQVWDDVRRLLVEKEMTHREFAAAMGTSFGGSSLWKHAPSRERLGRVAQVLDSAELDVLAVNDVLWDEVVAIEPDGEEQVYDATVLGGHNFVADGIAVHNSTYASLNGTSMATPHVAGAAALVKQKNPSWSNVQIRNHLKNTATSLGSTNLYGSGLVNAEAATR

SEQ ID NO: 336 - protein, 734 aa, Artificial Sequence
  Synthetic construct intein-modified proSavinase_S317:Mca_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTADTWVMTASGARQVRDLIDRPFEAVVDGECHPTESRGFFFTGDKPVLRLSTAEGHTLRLTANHPVLRVSKMTRQLRETEWVKAGELRPHDKIVLHDHRALPSWDGAHTEAEGYLIGLLIGGGTLTRDKAILSIWDAAAPKVANGGGSVPAAGVAGVMRAAELAARTLPHRTDFNGWQTTMEGRGEYHMATGALHTLALELGLTPGDKRLTAPLETTSSAFHRGLLRGMFDADGSVQGSQRKGVSIRLPQTDLGNLQTVQRMLLRLGVASTIHQNRRPGGTKVLPDGEGGAKGHSCQAAHELIISGENVVRYAERIGFADSDKMDRLTALLQRYRHTRHAERFIATVQSLEDDGMEAVYDVTVADVHAFDANGLYVHNSTYASLNGTSMATPHVAGAAALVKQKNPSWSNVQIRNHLKNTATSLGSTNLYGSGLVNAEAATR

SEQ ID NO: 337 - protein, 519 aa, Artificial Sequence
  Synthetic construct intein-modified proSavinase_S317:Memar_Pol-II
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAGDTEITVSDGRRWMSLPIRQFVTENFDISKPGLDHVGTFYSDPRQPFYVRSIDSQGKTSLKRVTSVSVHRAPAHLVRFATRRGRVLTVTPDHAMLVWDTDYLRKIKALEVAVGDRVPVEEGGLVVADEVVSRETVQALDDRVYCLTVAENHTLVANGIFCGQSTYASLNGTSMATPHVAGAAALVKQKNPSWSNVQIRNHLKNTATSLGSTNLYGSGLVNAEAATR

SEQ ID NO: 338 - protein, 624 aa, Artificial Sequence
  Synthetic construct intein-modified proSavinase_S317:Mex_helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAAGTLIKTPKGPVPIEQIQSGDLVFNAIGIGVVEGIVCQQKQTITLELSDGTSIVCTHDHPFFCPRGWVAAGDLEVGSGLFSHEDLRRLWSGGASLGLESGSSDGRGAVRSSEVLLRILREEAREPDAGYCGPAEDVRNASTDRAHAEGAWWQWQADPIASDEAARSAGRRVADRVRDEDRREARPEPTAVLLQDRHCEPLANDRNRSGREHSSRGTGEAEGQRQGDVPCSVRVVSISREERGGPEAVYNLRVSGHPSYFAGGVLVHNSTYASLNGTSMATPHVAGAAALVKQKNPSWSNVQIRNHLKNTATSLGSTNLYGSGLVNAEAATR

SEQ ID NO: 339 - protein, 519 aa, Artificial Sequence
  Synthetic construct intein-modified proSavinase_S317:Mhu_Pol-II
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFHGDTLIEIYADGILEEIPIRRFVLEHLDLSQAGVDALGTFYADPVRPAHVRSVDTGGIPHLRKITSVSVHKAPANLIQFSTSRGKNLLVTPDHAMLVWDVSYLRKIRALEVKIGDAVPVWESGVVISDRIVSIDYVPCEDERVYCLTVDRDHNVVGNGIFTGQSTYASLNGTSMATPHVAGAAALVKQKNPSWSNVQIRNHLKNTATSLGSTNLYGSGLVNAEAATR

SEQ ID NO: 340 - protein, 853 aa, Artificial Sequence
  Synthetic construct intein-modified proSavinase_S317:Mja_GF-6P
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNSTYASLNGTSMATPHVAGAAALVKQKNPSWSNVQIRNHLKNTATSLGSTNLYGSGLVNAEAATR

SEQ ID NO: 341 - protein, 855 aa, Artificial Sequence
  Synthetic construct intein-modified proSavinase_S317:Mja_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLNANTEILQESGFRKITELNKDEKVFALCGKEIKPVDGWKVHKTPQHEYNIVVKTVNGLEITTTPNHIFLVKENGSLKEKEAKDLKVGDYVATVDRIRVKEKDIDLSNGDLYFIGYFIGDGYTGVIEKNTLKATPDLAFNPKYPPNFDDSELHKKYFLKCRISKGVAHYIYSKKLRKIFNKLNMLTKDNKNIDAFCNLPLDKLAYLIAGLFDSDGYIYLNRKNIEFYSISEKLVEQLQFVLLRFGIHSSIRKKKTKTMVSPTNGKEYKCKDIYVLTIRDFMSIKRFYENIPLRHEEKRRKLEEIIKNKEIGQIPSEFVALRFTPIAKIWCDCGFSVDLTMFKPRTKRQRELNKKRVKLLFELLDGKKLITNYKEYYSKRKNPYFDFIVREKINGNNYYSLNEKGRVLMSLLNKHIKDKENLEEMYNFLVNLEKCPICGKPIHKEMRYSWKKECYDGDIYWDRIKEIKKIKVNDKYAYDIELPDDGSNSHYIVANGFIVHNSTYASLNGTSMATPHVAGAAALVKQKNPSWSNVQIRNHLKNTATSLGSTNLYGSGLVNAEAATR

SEQ ID NO: 342 - protein, 746 aa, Artificial Sequence
  Synthetic construct intein-modified proSavinase_S317:Mja_Hyp-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVPPDTLLILENGFKRIVDIKVGDKVLTHENRFKKVEKVYKRRYIGDIIKIKVRYFPEEIILTPEHPVYAIKTEKRCDGSHGICKFNCLTQYTNPSCKKRYRKYKREWIIAKDLKVGDVIVYPIPNRVRDIKYLSLDKYLSNIKREFCRSRIPEKIEVSEEFCRLVGYFLSEGYCFRDGIGFALGENEKKIIDDIEYLMKKIFNLKPKIRDDGRSEGIELKYYSRVLRDFFGDMFYCGDEKRAWNKALPNEFLYLPKNKQLQIFIGWWRGDKGVTTSEILMNQLRLISLRLGFIITFSKHVPKNPKIGDREVIKYHARWQGRVSILDEKIVDELKNEDIKLPKKDVRYGWIKGNYLYAPIIRIGREYYDGFVYNLEVEDDSSYVTVSGTLHNSTYASLNGTSMATPHVAGAAALVKQKNPSWSNVQIRNHLKNTATSLGSTNLYGSGLVNAEAATR

SEQ ID NO: 343 - protein, 900 aa, Artificial Sequence
  Synthetic construct intein-modified proSavinase_S317:Mja_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLMPHEKVLTEYGEIKIEDLFKIGKEIVEKDELKEIRKLNIKVHTLNENGEIKIINAPYVWKLKHKGKMIKVKLKNWHSITTTPEHPFLTNNGWIKAENIKKGMYVAIPRKIYGNEDFEKFIEFINSKILTNELIVKVNEKDLKNVELPSTKIYKKQKNVFRSEDIIEHNLNIEKISFSPRIHRCGKPQHYIKLPKSLNEWKAIFYFAGVMFGDGCVDRIANNDEEVFNKLKSLNNLGIEVERIKRKSSYEIIFKNGKNALINLLKILFDYPSEKKSHNIKIPQILYIAPKELVAEFIKGYFDADGYVNLRQNRIEVISASKEFIEGLSILLLRFEITSKIYEIKKSYKETKKKYYQLNIVGKRNLKNFKNIGFSIKYKEENLNKIIEKSRKSEKYPINKDMKRLRILFGMTRNEVNVSYYAKYENGKEIPSYEIVKKFLNSLKPKNLDKKIKVLEGKERDVNYLKAFESDGLIENGRLTKLGREALNIWKNHEFGKENIDYMKSLIENIAFVEVEDVEIIDYDGYVYDLTTETHNFIANGIVVHNSTYASLNGTSMATPHVAGAAALVKQKNPSWSNVQIRNHLKNTATSLGSTNLYGSGLVNAEAATR

SEQ ID NO: 344 - protein, 522 aa, Artificial Sequence
  Synthetic construct intein-modified proSavinase_S317:Mja_Klba
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGALAYDEPIYLSDGNIINIGEFVDKFFKKYKNSIKKEDNGFGWIDIGNENIYIKSFNKLSLIIEDKRILRVWRKKYSGKLIKITTKNRREITLTHDHPVYISKTGEVLEINAEMVKVGDYIYIPKNNTINLDEVIKVETVDYNGHIYDLTVEDNHTYIAGKNEGFAVSNSTYASLNGTSMATPHVAGAAALVKQKNPSWSNVQIRNHLKNTATSLGSTNLYGSGLVNAEAATR

SEQ ID NO: 345 - protein, 766 aa, Artificial Sequence
  Synthetic construct intein-modified proSavinase_S317:Mja_PEP
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNSTYASLNGTSMATPHVAGAAALVKQKNPSWSNVQIRNHLKNTATSLGSTNLYGSGLVNAEAATR

SEQ ID NO: 346 - protein, 723 aa, Artificial Sequence
  Synthetic construct intein-modified proSavinase_S317:Mja_Pol-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCHPKGTKVVVKGKGIVNIEDVKEGNYVLGIDGWQKVKKVWKYEYEGELINVNGLKCTPNHKIPLRYKIKHKKINKNDYLVRDIYAKSLLTKFKGEGKLILCKDFETIGNYEKYINDMDEDFILKSELIGILLAEGHLLRRDIEYFDSSRGKKRISHQYRVEITVNEDEKDFIEKIKYIFKKLFNYELYVRRKKGTKAITLGCAKKDIYLKIEEILKNKEKYLPNAILRGFFEGDGYVNTVRRAVVVNQGTNNYDKIKFIASLLDRLGIKYSFYTYSYEERGKKLKRYVIEIFSKGDLIKFSILISFISRRKNNLLNEIIRQKTLYKIGDYGFYDLDDVCVSLESYKGEVYDLTLEGRPYYFANGILTHNSTYASLNGTSMATPHVAGAAALVKQKNPSWSNVQIRNHLKNTATSLGSTNLYGSGLVNAEAATR

SEQ ID NO: 347 - protein, 830 aa, Artificial Sequence
  Synthetic construct intein-modified proSavinase_S317:Mja_Pol-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHNSTYASLNGTSMATPHVAGAAALVKQKNPSWSNVQIRNHLKNTATSLGSTNLYGSGLVNAEAATR

SEQ ID NO: 348 - protein, 902 aa, Artificial Sequence
  Synthetic construct intein-modified proSavinase_S317:Mja_RFC-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNSTYASLNGTSMATPHVAGAAALVKQKNPSWSNVQIRNHLKNTATSLGSTNLYGSGLVNAEAATR

SEQ ID NO: 349 - protein, 790 aa, Artificial Sequence
  Synthetic construct intein-modified proSavinase_S317:Mja_RFC-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNSTYASLNGTSMATPHVAGAAALVKQKNPSWSNVQIRNHLKNTATSLGSTNLYGSGLVNAEAATR

SEQ ID NO: 350 - protein, 897 aa, Artificial Sequence
  Synthetic construct intein-modified proSavinase_S317:Mja_RFC-3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNSTYASLNGTSMATPHVAGAAALVKQKNPSWSNVQIRNHLKNTATSLGSTNLYGSGLVNAEAATR

SEQ ID NO: 351 - protein, 848 aa, Artificial Sequence
  Synthetic construct intein-modified proSavinase_S317:Mja_r-Gyr
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTPDTYVVLGDGRIETIEDIVNAKERNVLSLDLDNLSIKIDTAIKFWKLRYNGNLSKITLSNNYELKATPDHCLLVLRDNQLKWIPAKDIKENDYIAMPFNYKVERKPISLLNLLKYLDITDVLIEFDENSTIFEKIAEYIRNNIKTSTKYKYLRNRRVPLKYLIEWNFDLDEIEKEAKYIYKSVAGTKKIPLFKLDERFWYFAGLVLGDGSIQDSKIRIAQTPLKDVKSILDETFPFLHNWISGNQVIISNPIIAEILEKLGMRNGKLNGIIFSLPESYINALIAGYFDTDGCFSLLYDKKAKKHNLRMVLTSKRRDVLEKIGIYLNSIGILNTLHKSREVYSLIISNKSLETFKEKIAKYLKIRKEAFINGYKTYKKEHEERFECDLLPVKEVFKKLTFEKGRKEILKDSKIHIENWYKEKTNNIPREKLKTVLRYANNSEHKEFLEKIVNGDISFVRVKKVENIPYDGYVYDLSIKHNQNFISNGVISHNSTYASLNGTSMATPHVAGAAALVKQKNPSWSNVQIRNHLKNTATSLGSTNLYGSGLVNAEAATR

SEQ ID NO: 352 - protein, 807 aa, Artificial Sequence
  Synthetic construct intein-modified proSavinase_S317:Mja_RNR-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSLGRDELIFIKEGDKLKVCKIGEAIDEFMEKYKDKIIVDGDTEILYLDGIAEVYTISVNVKTGKAEFKRVYAISRHKPRGKVYKVIGKDGTSIIVTEDHSLFNYDENGNLVCVKPRQMKHIIRNFNNPYDVEYRIGDYIETNYQRTDSKYNSRQNDIPEKLKITKELCQFLGLFVAEGSYITNGISITTKDDDIAKFIERFVKEQINENIAVKRYEDSVRFVNKGFYRFLKEHINGKAINKNSPEFILKGDKEMKLAFLGGLISGDGYVSKDGRVQIYTTSEQLLGQLHLLLSDLGMIYSITKIKEEGEKIEIKRNEIVRNYKLYVIEIAKNCTEDLKPYVIPKYKKERIKPANYDQLPYDYRIIKEHLRKITDKKPYNDYAWKSNNRKLKLNTLEKIEQLNPHLREEINKFKLNIPFEIKEIKEIDYNGYVYDLSVEDNENFITATGILCHNSTYASLNGTSMATPHVAGAAALVKQKNPSWSNVQIRNHLKNTATSLGSTNLYGSGLVNAEAATR

SEQ ID NO: 353 - protein, 887 aa, Artificial Sequence
  Synthetic construct intein-modified proSavinase_S317:Mja_RNR-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSLPYDEKILIFENNEYKLVKIGEFVEKYLNRYKDRAITYGDNNIEVYIKDENIYAPSFDKDGKIVLKPITHAIRHRGKEIYEIELESGKKVRVTGDHSVFTINDNLDVVEVKASDLKVGDFIITPKIIPSISKDKIYLSEIVKNKDKYYVKIKDHIKFIEEHEEILKESYKEYKTKWKDLKPVLKKKNAFRLDLIEDLVDKEKIEKISYGHANYINNKIKLDEKFGYLIGAFLSEGHWNDKCVEISSTNKEFIENLVEIIEEILGKDAYYITVKGDKRRYKDLYVIGLNKTVAMIFESLGLNKLSSNKEIPSILLSNETFLKGLIKGYIDGDGSIYVDESKRDYSIRLYTTSETLRDTLCLALKILGINYRLSIDKKSKVNENWRDCYVIKITGKENIEKLLDVEIKNNGGKDVIPKIAEKFKEIINQYSQREWKERFGIDVNNLHIWEDLKKGYMSRYRAKKVLNIMKNVKEIEEKYGRLLDKIGQLIDNDLLFERIKSIRVLDEIPEYVYDISVEGTENFIGGEGFICLHNSTYASLNGTSMATPHVAGAAALVKQKNPSWSNVQIRNHLKNTATSLGSTNLYGSGLVNAEAATR

SEQ ID NO: 354 - protein, 806 aa, Artificial Sequence
  Synthetic construct intein-modified proSavinase_S317:Mja_rPol_Ap
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVDGDTTVLLDGKLIKIKDLEDKWKDVKVLTSDDLNPKLTSLSKYWKLNADEYGKKIYKIKTELGREIIATEDHPFYTTNGRKRCGELKVGDEVIIYPNDFPMFEDDNRVIVDEEKIKKVINNIGGTYKNKIINELKDRKLIPLTYNDQKASILARIVGHVMGDGSLIINNKNSRVVFRGDIEDLKTIKEDLKELGYDGEEIKLHEGETEITDYNGKKRIIKGKGYSFEVRKKSLCILLKALGCVGGDKTKKMYGIPNWIKTAPKYIKKEFLSAYFGSELTTPKIRNHGTSFKELSFKIAKIEEIFDEDRFIKDIKEMLKEFGIELKVRVEEGNLRKDGYKTKVYVASIYNHKEFFGRIGYTYANKKETLARYAYEYLLTKEKYLKDRNIKKLENNTKFITFDKFIKEKCLKNGFVKEKIVSIEETKVDYVYDITTISETHNFIANGFLTGNSTYASLNGTSMATPHVAGAAALVKQKNPSWSNVQIRNHLKNTATSLGSTNLYGSGLVNAEAATR

SEQ ID NO: 355 - protein, 825 aa, Artificial Sequence
  Synthetic construct intein-modified proSavinase_S317:Mja_rPol_App
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSLPYEEKIIIKEGEFIKPVEIGKLVDEMIERFGFEKIGNSEVCDLPIDIYALSLDQDEKVHWKRIISCIRHKHNGKLIKIKTKSGREITATPYHSFVIRKDNKIIPVKGSELKIGDRIPVVKHIPANCVEAINISDYVSGNYVVDNINNKIAPKINGKSIPNNIKLDYDFGYFIGIYLAEGSVTKYFVSISNVDELILNKIRAFADKLGLNYGEYDNNNGFAESHDIRIYSSTLAEFLSNFGTSSNTKKIAEFVFGANKEFVRGLIRGYFDGDGNVNADRKVIRVTSNSKELIDGIAILLARFNIFSIKTKTKNQFVLIIPHRYAKKFHEEINFSVEKKKSELERLVSSLNDDKTYDSIDMIPSIGDALTKLGEKVDYPKVILKKFERKQKIGRATLQRHLRRIEELAVKKGVNILALKEYWLLKKAVESDVIWDEIVKIEEISCDKKYVYDISVEGLETFTTFDGVLTHNSTYASLNGTSMATPHVAGAAALVKQKNPSWSNVQIRNHLKNTATSLGSTNLYGSGLVNAEAATR

SEQ ID NO: 356 - protein, 842 aa, Artificial Sequence
  Synthetic construct intein-modified proSavinase_S317:Mja_RtcB_Mja_Hyp-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTSNSKILTDDGYYIKLEKLKEKLDLHIKIYNTEEGEKSSNILFVSERYADEKIIRIKTESGRVLEGSKDHPVLTLNGYVPMGMLKEGDDVIVYPYEGVEYEEPSDEIILDEDDFAEYDKQIIKYLKDRGLLPLRMDNKNIGIIARLLGFAFGDGSIVKENGDRERLYVAFYGKRETLIKIREDLEKLGIKASRIYSRKREVEIRNAYGDEYTSLCEDNSIKITSKAFALFMHKLGMPIGKKTEQIYKIPEWIKKAPKWVKRNFLAGLFGADGSRAVFKNYTPLPINLTMSKSEELKENILEFLNEIKLLLAEFDIESMIYEIKSLDGRVSYRLAIVGEESIKNFLGRINYEYSGEKKVIGLLAYEYLRRKDIAKEIRKKCIKRAKELYKKGVTVSEMLKMDEFRNEFISKRLIERAVYENLDEDDVRISTKFPKFEEFIEKYGVIGGFVIDKIKEIEEISYDSKLYDVGIVSKEHNFIANSIVVHNSTYASLNGTSMATPHVAGAAALVKQKNPSWSNVQIRNHLKNTATSLGSTNLYGSGLVNAEAATR

SEQ ID NO: 357 - protein, 689 aa, Artificial Sequence
  Synthetic construct intein-modified proSavinase_S317:Mja_TFIIB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSVDYNEPIIIKENGEIKVVKIGELIDKIIENSENIRREGILEIAKCKGIEVIAFNSNYKFKFMPVSEVSRHPVSEMFEIVVEGNKKVRVTRSHSVFTIRDNEVVPIRVDELKVGDILVLAKELPNIEEDIEIDKKFSKILGYIIAEGYYDDKKIVLSYDYNEKEFINETIDYFKSLNSDITIYSKDLNIQIEVKNKKIINLLKKLRVKNKRIPSIIFKSPYEIKKSFIDGIFNGKDAKVFVSKELAEDVIFLLLQIKENATINKKSINDIEVYEVRRITNIYTNRKLEKLINSDFIFLKIKEINKVEPTSGYAYDLTVPNAENFVAGFGGFVLHNSTYASLNGTSMATPHVAGAAALVKQKNPSWSNVQIRNHLKNTATSLGSTNLYGSGLVNAEAATR

SEQ ID NO: 358 - protein, 808 aa, Artificial Sequence
  Synthetic construct intein-modified proSavinase_S317:Mja_UDP_GD
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFHPDEVLFIDRGRGLECITFKELFELEDKDNVKILSFDGEKLSLKKLKLASKRYYNDDLITLRFNLGREIKITKDHPVVILEDGELKIKLTSDVKEGDKVILPYGNFGEEREIEIDILEELSKTDLIEKVWIHNKDLATNEFNIIKPYLSNKYPHDVKRNGTIRAKDILPIKEILDKYGSKNRLFTAKSKSTTIPYKIKIDKDFARLIGYYLSEGWISKDYGRNGVVRKRIGLCFGIHEEEYINDVKNILNKLGIKYIEKIKDGSHSILISSKILAYVFENILNCGINCYNKNIPPQMFNAKEEIKWEFLKGLFRGDGGIVRLNNNKNLNIEFATVSKKMAHSLLILLQLLGIVASVKKCYNNKSTTMAYIIRINGLEQVKKIGELFGKKWENYKDIAESYKRNIEPLGYKKSDNFAILEVKEIIKEHYSGYVYSVETENSLLITSYGILIHNSTYASLNGTSMATPHVAGAAALVKQKNPSWSNVQIRNHLKNTATSLGSTNLYGSGLVNAEAATR

SEQ ID NO: 359 - protein, 748 aa, Artificial Sequence
  Synthetic construct intein-modified proSavinase_S317:Mka_CDC48
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSIPGDEVVWAKVDGEAKLIPIEDLYELWKEGRDVEVAALTEEGVVWSSVDRVARHRRRTGLVKIITRTGREVIVTEDHSVFTVRDGKIVDVPTSELSEGDWIVLPARLPAGDSDEIDGIKIDEDLAFLLGLYVAEGSLTNQKDAVRIHNKDPEVIEEIDRIVREKGWEGRYYESDHSYWIKSRKLRQLCEKLGTKAREKRLGPLLSLKPELLAAALRGYYTGDGSFSVKPHGRSAIIEATTVSKRLADELLVALQILDIVARRYECDDTKGSTRYRVMITKSEYIRTFVEKVGFAQSEKNERIRKFLAERKWTRGRSDIPTELIGSPYTYVEVEYISDRVAADGGLMKAELEHLYFDKIKEIVPLDRDDEYVYDVVEVKLGHNFVGGQGVLLHNSTYASLNGTSMATPHVAGAAALVKQKNPSWSNVQIRNHLKNTATSLGSTNLYGSGLVNAEAATR

SEQ ID NO: 360 - protein, 876 aa, Artificial Sequence
  Synthetic construct intein-modified proSavinase_S317:Mka_EF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVAPETKICLADGRFVRADELFEELKERGRLVKCDESEEVYELREPVGVSSLDKDAVEIVEGKITHVWRLKADKLVEVEVKNGRSIRTTPEHKFLVLDPSGEIVEKRADELEIGDYIVCTQKLVHEGMSEEELKREVFRRLGRDFFVHLPEEEAESVLELAKERGIKALWETLEVDIEENSFYYQLRKGRIRADILVDLAEELGLDLADLYDAVEVSYRSNTKSTKPIRLPEPEDLFYLAGLMFGDGCWNQLTNGSEAIQGEVKRIASDMGLEVRVRRYEGKTARIDFPETVPRILEALFDYPRRKKAHRIRVNDFLTRAPLDCIAEFIRGYFDADGTVEEGRSAVSVTSVSREFLEDLQLLLQKFDVASYLREGDGAYTLYVSGARSLERFPGFREPEKAEKLKKLMEKASSSELEKVPISGEILREVRGDVPTTRMFNCYSNYEGGQVGLTKSSLEKVISTLEAVGVEGEALERLKALARDDVCFLEVVRVEEVEYDGYVYDFTVEEHHNFAAEGFVVHNSTYASLNGTSMATPHVAGAAALVKQKNPSWSNVQIRNHLKNTATSLGSTNLYGSGLVNAEAATR

SEQ ID NO: 361 - protein, 659 aa, Artificial Sequence
  Synthetic construct intein-modified proSavinase_S317:Mka_RFC
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSVSADTPILVRRGGEVLRVTFEDLDSWYFGDRGGEYVDVSDLEVLTVDRNFRVTWARVSKLIRHRARKILRVHLEDGTIELTGNHAVMVLDEGGLRAVKASEIEEGSFLLSFVAELDEQPTDGGTVVTSVGSGSRVSDTTYELPVEVRVELLRELADDGVIEASEDVSVDLAWLARISGVESRVTDDGVELVWETRTGDLLPADPVLKLVERLESDLVDDLESWVFDGRVSKEAVRKVLSSVDAKNLRGDARRAYRMLRTLVRSDVHAVKVEDLDVMDYDGYVYDVSVPGNEMFFAGEVPVLLHNSTYASLNGTSMATPHVAGAAALVKQKNPSWSNVQIRNHLKNTATSLGSTNLYGSGLVNAEAATR

SEQ ID NO: 362 - protein, 836 aa, Artificial Sequence
  Synthetic construct intein-modified proSavinase_S317:Mka_RtcB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAPGTKILTEHGCWVKVEDLPKMLTDQKLKVYDVDEGREDDSEIKFVMERGIEEDERAVVLVTESGLTIEGSEDHPVLTPEGYVELGEIEEGDLVVVYPFEGVEYEEKEGTILDESDFEDVDPQVLRYLEERDLIPLRWSDPKVGTLARILGFAMGDGHLGEQAGRLTLSFYGDERTLRELKRDLESLGVKANLHVRKRRYEIETASGRYEGEATSVELRVASRSFALLMEKLGMPRGRKVETPYKVPDWIKEAPLWVKRNFLAGLFAADGSVVKFKRYTPLPINLTQAKVEELEENLREFMNDVAKLLREFGIETTLYEVKSKKNVVYKLAIVGEENIKRFLGKVGYEYDPEKKVEGLAAYAYLKLKERVKKDRKEAAETAAEVYEETGSITKAHEAVADVVNRRFVERVVYDGGISSVRVPEDFPTFERFKEERVLAGGFVIEEVVEVKGVEPEYDRFYDIGVCHGAHNFIADGVVVHNSTYASLNGTSMATPHVAGAAALVKQKNPSWSNVQIRNHLKNTATSLGSTNLYGSGLVNAEAATR

SEQ ID NO: 363 - protein, 871 aa, Artificial Sequence
  Synthetic construct intein-modified proSavinase_S317:Mka_VatB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAPGTRVITASGDVVEIDEIVERAAETAVDGGLREGSTEVTVGVTNVRTLAAWDGDLTSNDVVAVEKIEAPSRAVRVRTRSGAELVVSEDHKFLVDTEDGPRMVEASELKSGDELYSVRELRVSEKVPTYLELLLEAEDKFYVHPTEEFEEAVAERYGSLAEACREKELPYRAREAKERRYYELSEFARLATAVIESVDEATEYIDYVTAGGRKRVKFSSPRPGKEVMYVAGLIASDGSVDTERGFVMFSNTERELLSAFEEIVTEEFGVDASKTENQNGVTMLRVNSRVLARVFERLADPKTVLKMPRELVAAYLAGYVDGDGHLKDGKIVITTADRERAGDLQLLLKRLGVPSVLRERDGAYDVVVTGHDAAELAEELPLRHPKKAEAAASMSSGRRSSRFDRVSRRFGRLLREVRRKYGVRASDLGSSSTISQIESGERRATRRLALEIVERLEEVVGDVEEVRELRELAEGNYVLDEVVEVETVEYEHEYLYDVTVVPDHTLVVENGIITSNSTYASLNGTSMATPHVAGAAALVKQKNPSWSNVQIRNHLKNTATSLGSTNLYGSGLVNAEAATR

SEQ ID NO: 364 - protein, 671 aa, Artificial Sequence
  Synthetic construct intein-modified proSavinase_S317:MP-Be_gp51
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCSWTNARAVTRRGFVHVDDLTTDDEVMSVDDQGRTIWQQIDEVVRFPFSGTLYSLGGREINATITANHRVVGLNREKTKWVEHTPTSLPGNKMWVYTAGEGSNEDYPLTDTEIRLAVWGLTDSHRSPDGRWTFYQSGEKAEQVRKLLADAGIEYRERARNRGITEIDGKVLKAPPKTQYEFSLGKVQELDDLLDRGRSELPTWTLSLSQRQARLFLEEYRFTDGTDTTSAGDSYVLYVCKDRMREQLQMLAAANGLRASTTEYRPGHWRLNISNRALSGLYKNTVEEVAYEGEVWCLRVPNGRFFIEDGGKIHLTGNSTYASLNGTSMATPHVAGAAALVKQKNPSWSNVQIRNHLKNTATSLGSTNLYGSGLVNAEAATR

SEQ ID NO: 365 - protein, 684 aa, Artificial Sequence
  Synthetic construct intein-modified proSavinase_S317:MP-Catera_gp206
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSLACSTPILTTNGWSTMGALQDGDEVYAPDGQPTKVIKAHPINLNRPCFKVRFRDGQEVVTDAEHLWQVNDRNNGGRDRVMTTQEIADAPWGGRYRFRVPVTEPLQTPEADLPVDPWLLGAWLGDGDASMVSICSGSQDLDYLISRVEGLGLSHRVNRYGSRAASVYVHGMRAVFSELGLLKNKHIPDRYLTASVAQRRQLLAGLMDSDGTVSDRQVTISMKNERLMRQVLQLVRSLGYRAGFGSRMARLNGRDCGLVYVVRFHTGWGESPFDMPRKRDGWEQATKTSVQNLRLNAIVAVEPVETVPVRCITVAHESSLYVAGEGFVPTHSTYASLNGTSMATPHVAGAAALVKQKNPSWSNVQIRNHLKNTATSLGSTNLYGSGLVNAEAATR

SEQ ID NO: 366 - protein, 790 aa, Artificial Sequence
  Synthetic construct intein-modified proSavinase_S317:Mxa_RAD25
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVKNDSLIFTDRGLVTAAELAVGVPEEHAAFTEVGVDTSTGRATTNAVYNGGRSPTKRARLALGYELEATPEHPIRVLRDDALAWVRMDELHVGDRVALRRGSEVWGRSSLPEAFRWVKPKYAANLKLPKGLVLDEVAAEACGLLVSEGTLTKRLVTEFTNADADNVGFISRWAASIGIDLSRNGSDSIQYLLCSVVLREWLAWLGLDYTRAAGKCIPRAVRFGGRDIMRAFLRGLFDGDASVDPLKGVIEFCTASERMAREVQVALLGLGILASRHSRTVAGYEQLYWRVTVNDVATFEREVGFSSNWNRLRLREAVARAEGRCRNPNVDTVPINGLVERLYRTAQKQLSWSSQEGRIFGNYVHGEHAPSRAALERMVQRWGSECPTECLPIEAFLELPVAFLSVESIEDGEADVVDLSVPETHEFVANGVVCHNSTYASLNGTSMATPHVAGAAALVKQKNPSWSNVQIRNHLKNTATSLGSTNLYGSGLVNAEAATR

SEQ ID NO: 367 - protein, 779 aa, Artificial Sequence
  Synthetic construct intein-modified proSavinase_S317:Nfa_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLPASTRILRADTGAESTLGELLASGEQPLVWSLDERMRMVARPMVKVFPSGRKEVFRLRLASGREVEATGNHPFLTVDGWIPLDRLTVGDRLATPRSVPEPVHTERMADAEVVLLAHMIGDGSCVRRQPVRYASIDEQNLAAVSEAAEHFGVTAVRDDYAAARVTTLRLPAPYRLSRGKRNPIAAWLDELGLFGLRSHEKFIPRRVFALPNDQVALFLRHLWATDGSVRWDSTYRQARVYYTSTSRRLIDDVAQLLLRLGVHGRIRRVTKPGYRDAWHLTIDGADNQTVFLRDVGVHGARGDAAQVALAELEPLVRNTNVDTVPNEVWNQVRHLLATKNITHREFSAAMGSRFCGSTMWKRSPSRSRLARVAAVLDDADIEMYATNDVFWDKIVEITSLGEQDVYDGTVPGTHNFVAQSISVHNSTYASLNGTSMATPHVAGAAALVKQKNPSWSNVQIRNHLKNTATSLGSTNLYGSGLVNAEAATR

SEQ ID NO: 368 - protein, 667 aa, Artificial Sequence
  Synthetic construct intein-modified proSavinase_S317:Nfa_Nfa15250
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFPAGTVVSGPSAEAATRRWFEGELVVFTTASGKQLSLTGNHPVLTRGGWVPANLLNEGDEVVRSTRPQGATPLVVPDHHQVPALIEDVWGSFAVNGLHRVPAAPEDFHGDGQRGEVDIVGPDRTLWCGHDAAIAQQREQQFFTRRTESSGLLVAESVAQLVDLWQAPHSGSSIGRSGLPFALIGGHGGGPVERGLTVAAGGYPGLHEALADYRPGDAVLPPQGVFAGSSEIGGDDCVIGKVDSTRWDAPALPFLVEGRAGYASRGKELFDRLTGQVELDRIVILRRVQWSGHVFSLTSSEGWHTGNSLIVSNSTYASLNGTSMATPHVAGAAALVKQKNPSWSNVQIRNHLKNTATSLGSTNLYGSGLVNAEAATR

SEQ ID NO: 369 - protein, 763 aa, Artificial Sequence
  Synthetic construct intein-modified proSavinase_S317:Nfa_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFPAGTPVDTIDGPKPIESLRAGDRVLSHDGSYATVEKLIENTNDQPLVSISHFGHKEPIRCTPEHPILVWTDRDVETLIDGDGADPFNGFVWLAAQDVHPSDFIVATAPLETRERRVFDLMNHVGEGTYEEVDGLIRKVNTDARHRNKQRHRQGFVAVTRYVEESYDLGLILGWYLAEGHVSKRSGVEDVRPTGVHFTLGANEIERHVELGMAFKQVFGVDLVLHTNHSDHSTRMVCNSKIVASLLLSLAGTGYSTKRLAHEVMTADEDFQRGLLVGLFRGDGCTTTGGMVLDLVNQELIDQVQLLLRRLGIVSVVRTYTNQAGNPTGQVFVPGLPGTNEEFIFDVDKNLQNYTGRKGTKRTTYQVVHGRHVYGIRAVERTGETPRQVYNLHVEGTHTYTIRGAVVHNSTYASLNGTSMATPHVAGAAALVKQKNPSWSNVQIRNHLKNTATSLGSTNLYGSGLVNAEAATR

SEQ ID NO: 370 - protein, 693 aa, Artificial Sequence
  Synthetic construct intein-modified proSavinase_S317:Nph_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVDGDTSVTLASGDEKPIRDIVESTLEDPTEISDGFYQESDIDVLTTDGGAVAPGRATKVWKRQAPEKMYRIRTESGRELEVTPSHPLFVQSEGGLSPLVADDLSENDFVAVPRALPADDGDDFGQHVDDLGSVTARKTADAEAVRSEDAATTPDVIPNVGDQLRRIRTSLRLSQHDCGLPRSTYQQYERGDRNPSRSRLQTVLTAFERRIEQLSSLSDRVDDGDSDAIAAARDELNPSQASLASGMDATRTAIGDDERTEARPDGGAVADAERAVADALCRALAVADDVERLRSLADGDIGWDRIDSIEPVEPEDEWVYDLEVESTHSYLSNDVVSHNSTYASLNGTSMATPHVAGAAALVKQKNPSWSNVQIRNHLKNTATSLGSTNLYGSGLVNAEAATR

SEQ ID NO: 371 - protein, 846 aa, Artificial Sequence
  Synthetic construct intein-modified proSavinase_S317:Nph_rPol_App
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSIPADEQVVVRRNGETELTEIGPLVDSLMDSRETRSFDDHEVTLAPDGIEVPSLSSEETVEWKPIEEVSRHETPDELLRFELESGRSIRATKAHSFVTRQENEVVPVAGEELEAGDWLPVVASLDATDTQETVDLRKYLPAGDYWYTSVLADGGAEAVPGGPDQLRNKRAALEAGELAEHTAYPVQGTVGLPEQFPLDEETGFFVGAWLAEGSLADHYVSISNVDAAFQSRIRSFAERFDLTVNEYENDSGFAAGYDIRLNGTILSDFLRAACTDDGEKSIPGFAIGANEAFLKGLLQGYFSGDGNVGTNAIRSSSTSDRLTAGVGLLLARFDVYATLGQQEDSRTLRVPKKHVSRFDNRIGMVGERGAELEALAESADSDGPDATDQIPNFGDALEAVAEAADIPQRQVNSATKRQRIDRSRLARLVAAAEAELDGEQSELDALRQAVTGDVVWDRIESIETVESDHEYVYDVSVEGLETFTTADGVVTHNSTYASLNGTSMATPHVAGAAALVKQKNPSWSNVQIRNHLKNTATSLGSTNLYGSGLVNAEAATR

SEQ ID NO: 372 - protein, 676 aa, Artificial Sequence
  Synthetic construct intein-modified proSavinase_S317:Npu_GyrB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFIGDTLIPLADGKSYRIKDLMDWGTEFIVYACTPTGKIVAAQATAKLTRRNAPLVKVILDNGEEIICTPDHQFMLRDGTYKEAQLLQAETSLMPFYSKTDKDGYTLITQPYSSRWQKAHWIIARSGLLGKVPRFEGQKTFIHHQNFDESDNRPENLEFMGNRDHSAYHRSLVERNQHWHSAEFEEKRVASLAQKAKTSEGYQYYAERGTRNIFQYMEQQPEHFKNAVAGNGNRGKQYLVEYNKTEKGRGKSQEIANRYYTCEICGVDVKTPIGLHNHRRKEHQCNHKVVAVNLLNYTEDVYCLTVPEYHNFALKAGVFVHNSTYASLNGTSMATPHVAGAAALVKQKNPSWSNVQIRNHLKNTATSLGSTNLYGSGLVNAEAATR

SEQ ID NO: 373 - protein, 706 aa, Artificial Sequence
  Synthetic construct intein-modified proSavinase_S317:Nsp-JS614_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGALALDTALPTPSGWTTMGDVQVGDQLYDAHGRPTTVVAATEVLTGRPCYEVEFSDGSRIVADAQHQWLTESRAARKSRWAADKQYNRARNQNIVASVVTTEAIAGTLRVGADQRANHAVLTADPLSGSDVDLPIPPYVLGAWLGDGHSASARITCETPEIPMYLEACGLRVDHQGAMLYSLKFPDGDPRGSVQGVLRTIGVLNDKHIPADYLRASEGQRRDLLAGLMDTDGTVVRGVGSCQFAVTNKRLADDVYELVVSLGYKCGRTTRRVQGRSPETSTCHILNFSTVDDVFRLERKHLLHKEERPVTRARIARRYITAVRPIESVPVRCVEVDNTEHLYLAGESMIPTHNSTYASLNGTSMATPHVAGAAALVKQKNPSWSNVQIRNHLKNTATSLGSTNLYGSGLVNAEAATR

SEQ ID NO: 374 - protein, 761 aa, Artificial Sequence
  Synthetic construct intein-modified proSavinase_S317:Nsp-PCC7120_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLPEDALVHTAKGLVPIRDVQVGDLVQTPLGFRRVVDKFDQGFQDVYEIETNATYPRATLNHRQAVLEDAKGGIVWKHIASLEAGDRLLHNKQVLPGTVTHLPADFTESRPSHSRTAKSFVVPELTAEVAWLIGFTHGDGYVALGRNKYDKPYGRVEWSMNSLDAEVTSRIQAKIDAALALFGLSAVHSITKGENTAKSICSSIRLAEYFHRHIKQPNIPLTVPSFILQGSVDIRAAYLAGLMDSDGAVNNRPPHLITSVYRSFIRQVSVVLSSLGIAGRLTTTYPQNSNWQVKYNLTIPALKERYNALISPHSAKGELRQGLKMYGFTVPGAVMRETYTYSEMREMGFQGSRTVDANYERYVAEADISLDIPVTVKGLGSYDHVQTYDIEVDEAHCFYCDGYLTHNSTYASLNGTSMATPHVAGAAALVKQKNPSWSNVQIRNHLKNTATSLGSTNLYGSGLVNAEAATR

SEQ ID NO: 375 - protein, 518 aa, Artificial Sequence
  Synthetic construct intein-modified proSavinase_S317:Pab_CDC21-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVDYETEVVLGNGERKKIGEIVERAIEEAEKNGKLGRVDDGFYAPIDIEVYSLDLETLKVRKARANIAWKRTAPKKMMLVKTRGGKRIRVTPTHPFFVLEEGKVAMRKARDLEEGNKIATIEGLSVSWDEVAEILEYEPKDPWVYDLQVPGYHNFLANGIFVHNSTYASLNGTSMATPHVAGAAALVKQKNPSWSNVQIRNHLKNTATSLGSTNLYGSGLVNAEAATR

SEQ ID NO: 376 - protein, 622 aa, Artificial Sequence
  Synthetic construct intein-modified proSavinase_S317:Pab_CDC21-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVAPETLIITENGTKEIGEVVERWMKELGEIEYDDGISYSPAFEKVASLNGGKVKMLPVRRVWKLRSPGKMIKIRSESGKQITVTPETKLLTIIDGSLEWVEARKLKKGNYVAVVNKERSIVPIGDFLAKLLKFYGVELNLNEAVERDQARKLLETLKSKGLSDVTIEIPEKLRRFIKCDRVRYVDLVEMLSSMEGELKEEVMLLLSDVGDIHEVIQERLKEIGKILESDASWERIAEVEEVVRDGHVYDLTVEGSHSFIANGFVVHNSTYASLNGTSMATPHVAGAAALVKQKNPSWSNVQIRNHLKNTATSLGSTNLYGSGLVNAEAATR

SEQ ID NO: 377 - protein, 748 aa, Artificial Sequence
  Synthetic construct intein-modified proSavinase_S317:Pab_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLLPDEKVVVPSVGFVTLKELFETASKVVERDDEKEIRELDERITSVNGDGKTGLVKASYVWKVRHKGKVIRVKLKNWHGVTVTPEHPFLTTKGWKRADQLRPGDYVAVPRFIHGNEDEKIFLSYVKVKKSGEEWKEYFYLAGRKGNIDVNLLFVAPKRYVVEFLRGYFEERSEVKGESVIVEARELVEPLSLALLRFGIFSKIQGSKLIVTGKRNLEAFKDYIGFKDEREKALEEAIEKVKGSEVYPIFEEIRRLRLLFGFTREELGSYAKYENSEAPTYEELMEILDFIERGSPSLSKKIAILEGKLKAELRVLEEEGLIKDGKLTPLGRELLEVWRNREFDSKDVDYIRNIAETLVFIPVENVEEEEYDGYVYDLTTETHNFIANGILVHNSTYASLNGTSMATPHVAGAAALVKQKNPSWSNVQIRNHLKNTATSLGSTNLYGSGLVNAEAATR

SEQ ID NO: 378 - protein, 550 aa, Artificial Sequence
  Synthetic construct intein-modified proSavinase_S317:Pab_KlbA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGALYYFSEIQLPNGKEFIGKLVDELFEKYHDKIGKYKDMEYVELNEEDTFEVISIGPDLSARRHKVTHVWRRKVKDGEKLVKIRTASGKELVLTQDHPVFVLLGRDVARRDAGNVKVGDEIAVLNTRPDFSVLSPPAMPELLSEPFNYELSSIGDVAWDEVVEVDEIDAKGLGVEYLYDLTVDINHNYVANGIVVSNSTYASLNGTSMATPHVAGAAALVKQKNPSWSNVQIRNHLKNTATSLGSTNLYGSGLVNAEAATR

SEQ ID NO: 379 - protein, 687 aa, Artificial Sequence
  Synthetic construct intein-modified proSavinase_S317:Pab_Lon
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFSGEETVVIRENGEVKVLRLKDFVEKALEKPSGEGLDGDVKVVYHDFRNENVEVLTKDGFTKLLYANKRIGKQKLRRVVNLEKDYWFALTPDHKVYTTDGLKEAGEITEKDELISVPITVFDCEDEDLKKIGLLPLTSDDERLRKIATLMGILFNGGSIDEGLGVLTLKSERSVIEKFVITLKELFGKFEYEIIKEENTILKTRDPRIIKFLVGLGAPIEGKDLKMPWWVKLKPSLFLAFLEGFRAHIVEQLVDDPNKNLPFFQELSWYLGLFGIKADIKVEEVGDKHKIIFDAGRLDVDKQFIETWEDVEVTYNLTTEKGNLLANGLFVKNSTYASLNGTSMATPHVAGAAALVKQKNPSWSNVQIRNHLKNTATSLGSTNLYGSGLVNAEAATR

SEQ ID NO: 380 - protein, 809 aa, Artificial Sequence
  Synthetic construct intein-modified proSavinase_S317:Pab_Moaa
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFPPTEEAVFKFGDKVKIATFEEVAKNFKFEHKVEIDGFKGEYSIPNDLYVLTFNDGKAEWTRVTKFLRRKHEGKIRVIKTKTGRTIRTTPEHKFFVYKDGELVKKRADELEPGDELVLLWRFESEETLTEINLLEAFKDLPQEEKEKVYVRGIKDLDLTPLKEKYGDKVYYWARQDSMPLSVFYELNVDLDKEFRLGRDATTYELPSKLKITPSLAKLIGYFVSDGNYSDKDLRITVGHEDVEKEIVNILEELGLPYSFLEWEGKTKQIVIGSRLLRLVFKHVFKIPEGAPNKRLPEGFLSFPFEAKVALLSGLFNGDGYVVRGEHHLSIGYASTSKGLIRDILYLLASLGIFARVYRVPKEKMKGANHDLYKLYIAGTDLVRLVELLELREGHREKLGEIGNRKPARVKKIADFYIDVVDEVSEEEYSGYVYDLEVENEGHSFVAADGILVSNSTYASLNGTSMATPHVAGAAALVKQKNPSWSNVQIRNHLKNTATSLGSTNLYGSGLVNAEAATR

SEQ ID NO: 381 - protein, 539 aa, Artificial Sequence
  Synthetic construct intein-modified proSavinase_S317:Pab_Pol-II
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFPGDTRILVQIDGVPQKITLRELYELFEDERYENMVYVRKKPKREIKVYSIDLETGKVVLTDIEDVIKAPATDHLIRFELEDGRSFETTVDHPVLVYENGRFIEKRAFEVKEGDKVLVSELELVEQSSSSQDNPKNENLGSPEHDQLLEIKNIKYVRANDDFVFSLNAKKYHNVIINENIVTHQSTYASLNGTSMATPHVAGAAALVKQKNPSWSNVQIRNHLKNTATSLGSTNLYGSGLVNAEAATR

SEQ ID NO: 382 - protein, 853 aa, Artificial Sequence
  Synthetic construct intein-modified proSavinase_S317:Pab_RFC-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHNSTYASLNGTSMATPHVAGAAALVKQKNPSWSNVQIRNHLKNTATSLGSTNLYGSGLVNAEAATR

SEQ ID NO: 383 - protein, 962 aa, Artificial Sequence
  Synthetic construct intein-modified proSavinase_S317:Pab_RFC-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHNSTYASLNGTSMATPHVAGAAALVKQKNPSWSNVQIRNHLKNTATSLGSTNLYGSGLVNAEAATR

SEQ ID NO: 384 - protein, 753 aa, Artificial Sequence
  Synthetic construct intein-modified proSavinase_S317:Pab_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCIDGNAKIIFENEGEEHLTTMAEMYERYRHLGEFYDENYNRWGIDVSSVPIYVKSFDPETRRVVKGRVRAIWKYELGEEIPKYEIRTHKGTKILTSPWHPFFVLTPDFEVIEKRADELKVGDILIGGMPDGEDHELIFDYWLAGFIAGNGNLDDSEREYKARELLDGIENGIPPKILRKGKNAVLSFITGLFDAEGHVNDKSGIELGMVNKKLIEAVTHYLNSLGIKARMREKRRKNGIDYIMHVEEYSSLLRFYELIGKHLQNNEKKEKLEILLHKHNGGAFDLSLNFNAFKEWASRYGVEFKTNGNQILAIIGNEKVSLGQWHARGHVSKAVLVKMLRKLYEVTKNDEVKEMLHLIESLEVVKEITITNEPKTFYDLTVDKYQNYLAGENGMIFVHNSTYASLNGTSMATPHVAGAAALVKQKNPSWSNVQIRNHLKNTATSLGSTNLYGSGLVNAEAATR

SEQ ID NO: 385 - protein, 792 aa, Artificial Sequence
  Synthetic construct intein-modified proSavinase_S317:Pab_RIR1-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFTGDTRILTEKGLIPIEEIVHETGKKPKVVTHAGLKDIIETYDNGEMEVFRVTTEDGYELKVTGDHKFLVFDENGNPTLKPLKELKVGDYVYILAPEWKGGEYVELDTNIELKGKGYNVNLPSKLDEKLAYLLGIIYADGHIRHYFENGKRKNSKIEIYLHQDETEIKEKVKRYFKEIFGIEPKEFLKEEQHKVILVIPSTKIVKFLEINGLLKDKSENIRVPEAIFRSRPSVIAAFLAGFFDGDGSIDQNYRIAFKSISREFIKEAQLLFLALGIVTSIQEYNPPNPNNKTVYTLRVQTRDMKIKAFNVLKESVKLSKIMKEAISKLEENGKNKKFSFPFNAIYHIKDPKIRAKIQRDYKILSYNSKVTHRAFINNILKLKEELGLDDEEVKYFEMLSKLYPTKITKIEPLGKAHVYDLQVEDVHLLTGNGIYTSNSTYASLNGTSMATPHVAGAAALVKQKNPSWSNVQIRNHLKNTATSLGSTNLYGSGLVNAEAATR

SEQ ID NO: 386 - protein, 736 aa, Artificial Sequence
  Synthetic construct intein-modified proSavinase_S317:Pab_RIR1-3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHNSTYASLNGTSMATPHVAGAAALVKQKNPSWSNVQIRNHLKNTATSLGSTNLYGSGLVNAEAATR

SEQ ID NO: 387 - protein, 790 aa, Artificial Sequence
  Synthetic construct intein-modified proSavinase_S317:Pab_RtcB_Pab_Hyp-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAPGSKVLTEHGYWLKVEELPEKFKLQGVKVYNLDEGHNDTSNVAFVAEREVETGEMAVRVTTESGRIIEGSEDHPVLTPEGYVYLGNLKEGNLVIVYPFEGVEYEERKGVILDEDAFKDEDPQVLSFLREKGLVPLRWDDPRIGTIARILGFAFGDGYLGEMGGRLTLTFYGKEETLRELKKDLERLGISANLYVRESIETTSGHSEGKSLSIELRVTSRSFALFLEKLGMPRGKKTEKAYRVPGWILEAPLWVKRNFLAGLFAADGSIVEFKGNTPLPINLTQSKSDELAENLVEFLGDVAKLLAEFGIETTLYEVKSKKGVTYRLSIVGEDSIRTFVERINYEYDPEKKVKGLIAAAYLKLKERIVKEAHEAVKDDFPTFEEFAKERGYEGGFVAEKVVKVERVKPEYTKFYDIGVYHEAHNFIANGIVVHNSTYASLNGTSMATPHVAGAAALVKQKNPSWSNVQIRNHLKNTATSLGSTNLYGSGLVNAEAATR

SEQ ID NO: 388 - protein, 783 aa, Artificial Sequence
  Synthetic construct intein-modified proSavinase_S317:Pab_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVDGDTLVLTKEFGLIKIKDLYKILDGKGKKTVNGNEEWTELERPITLYGYKDGKIVEIKATHVYKGFSAGMIEIRTRTGRKIKVTPIHKLFTGRVTKNGLEIREVMAKDLKKGDRIIVAKKIDGGERVKLNIRVEQKRGKKIRIPDVLDEKLAEFLGYLIADGTLKPRTVAIYNNDESLLRRANELANELFNIEGKIVKGRTVKALLIHSKALVEFFSKLGVPRNKKARTWKVPKELLISEPEVVKAFIKAYIMCDGYYDENKGEIEIVTASEEAAYGFSYLLAKLGIYAIIREKIIGDKVYYRVVISGESNLEKLGIERVGRGYTSYDIVPVEVEELYNALGRPYAELKRAGIEIHNYLSGENMSYEMFRKFAKFVGMEEIAENHLTHVLFDEIVEIRYISEGQEVYDVTTETHNFIGGNMPTLLHNSTYASLNGTSMATPHVAGAAALVKQKNPSWSNVQIRNHLKNTATSLGSTNLYGSGLVNAEAATR

SEQ ID NO: 389 - protein, 1003 aa, Artificial Sequence
  Synthetic construct intein-modified proSavinase_S317:Pan_CHS2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLSPDTMVRTTNGDKPIRDIAVGDQLFDHEDRPVQCLAAEAIQTSRMMKVTYTGYNSVSKSSFTCTPDHIMTLVAYGVKPFRHSNSNRVTWWTRCDRTELGADAVEIKWDAAMHDLYTEYREQLGRRPTDAEVRKYLKAITSTRVVPDSEDDDSQRVEETYQSPVLIKLLAKLKAMDVDVDGEDESVVLMLLQQHMEDYLEHMIPEPEDISDEDNDDLIIDLDTNRKRKIGTISTLSSRISDKTFRQSPSIKSSPVNSQQQSQNEASQSTVPTYASVLTEDDHREMFAPVRSKLAVRDPKCKCQNLSCKGLRRVSTVFETSEQADLALELLSGDHYRVVDPCAVQDMEVFTMTLEEYQATCTAPMTQHKSKLRLYRSPLRFQPYQGSVSPVPIDPFWFGFWLGNGTKNNSEITSTDPEVEVYTQALVDRLNRDSIPPGKAPLKVSKYKIDIGTKHVYKGEEIKTTKVAHRLRVMSTVSNLDKTHWNPVHDGLRELGLLGDKSGGIPDCYMNADENTRLAVLAGLIESDGWLSHGLNCYGFGQYTYELKKLVEDARKLALSCGIQCNPIFERKNGKDRPEPGWFFYMGRGVEKFQPHLLLPRKRMTIPFTTSKNRDVRPFDVEDAGDGEFRLIEVSGELFQLADRTVVHNSTYASLNGTSMATPHVAGAAALVKQKNPSWSNVQIRNHLKNTATSLGSTNLYGSGLVNAEAATR

SEQ ID NO: 390 - protein, 927 aa, Artificial Sequence
  Synthetic construct intein-modified proSavinase_S317:Pbr_PRP8
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAKGTLLLRYDGTKVEVENVREGDLLLGPDGGPRRAFNIVGGRDRLYRIKMEGGKEDLVVTPNHILVLHREKRDGVDKVYARPFALPLLQEDATDDGEDLSEISAIEHFDTMEITAADFASLDPNERKLYRLFTSPGYELNGRPVPIDPYFLGLWLGDRSRTKSSIYTNHEEEIREFIADHAAELDLQLVSYVSNRPSLAAMKNGNQLPLRHQARQTIRKQRIAAKSITQPGGARSSSYPATNGGLSSNTVTSLHSRERHPLSESSAAATMNLLPRSTSVSTSVAAQPKSSMSTFITDAILPSESSNISVISDSGIEISKSSKMLSEEEADLDLFDIDSEDEEIEDLDEKKNVSNVDEFPKRRRIHYLRTGCRTYGELCPGEEDQILEDIVGRPDGTTSVESLLLALEALGLHTCGTNDSGSDKKRIPSVYMKNSRAVRLALLAGLIDSGGWYVDSENTFGFSQTEDSNSTLIWDVVTLARSLGFSVSTKRRMTHKPTRTQHKAQEFAQISGNVAEIPSLLARERGVERPISQAHSFKIKDIQLETEATEWAGFRVDQDQLYLRHDFLVLHNSTYASLNGTSMATPHVAGAAALVKQKNPSWSNVQIRNHLKNTATSLGSTNLYGSGLVNAEAATR

SEQ ID NO: 391 - protein, 515 aa, Artificial Sequence
  Synthetic construct intein-modified proSavinase_S317:Pch_PRP8
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAKGTRLLRYDGTEINVEDVREGDQLLGPDGEPRRAFNIVSGIDRLYRVKIGGEKEDLVVTPNHILVFYREGPSDGPENAERQTVEITAAEFATLSTEERSLYSAFTSPAVEKGAEGSAAQMHSFKVEDISLESEKTEWAGFRVDKDQLYLRHDYLVLHNSTYASLNGTSMATPHVAGAAALVKQKNPSWSNVQIRNHLKNTATSLGSTNLYGSGLVNAEAATR

SEQ ID NO: 392 - protein, 721 aa, Artificial Sequence
  Synthetic construct intein-modified proSavinase_S317:Pfu_CDC21
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVAPDSLVVVNDKVQEIGKLTEEWGREVGFLEYSSGIFYAPYLGRGISLDLVTGKVKPSVVSKVWKLKSPEELVTIKTITGKEITVTPETKLLTFNGTLEWKEAGKIKPGDYVLTVKKLHINGKQETLDEKLAYKRGLSLSDPLEFFSSSERTISAYLKGIFDKVGRLVGDTAVIKVDKDMAKRLQILLLRLGIVSSVDETGKVIIGREYIQKILGYNVSVVTHEVELFREFIAEISKFYGTSEEDVYSSLHEKGELDIGTVPVELPEGLREEINRERATYSELVKIAQEIKDEKLYNKLAWILSEVTEEEAKIKEKVNTLKVILSSDLIPERVESVKIIKSPYPYVYDLTVEGSHSFIANGFVVHNSTYASLNGTSMATPHVAGAAALVKQKNPSWSNVQIRNHLKNTATSLGSTNLYGSGLVNAEAATR

SEQ ID NO: 393 - protein, 741 aa, Artificial Sequence
  Synthetic construct intein-modified proSavinase_S317:Pfu_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLLPEEKVVLPEIGLVTLRELFELANEVVVKDEEKEVRKLGKMLTGVDERGNVKLLNALYVWRVAHKGEMIRVKVNGWYSVTVTPEHPFLTNRGWVKAGELKEGDYIAIPRRVYGNEDLMKFSKIAKELGIKGDEKEFYLAGASLDIPIKVLFLAPSKLVSAFLRGYFDAKGVVRENYIEVPLFEDLPLLLLRFGIVSRIEKSTLKISGKRNLELFRKHVGFTDSEKAKALDELISKAKESERYPILEELRRLGLLFGFTRNELRIEENPTYEVLMEILERIERGSPNLAEKIAVLEGRIKEENYLRILEEEGLIENGKLTELGKELLEVWRNREFDSKDVDYVRNIVENLVFLPVEKVERIEYEGYVYDVTTETHNFVANGILVHNSTYASLNGTSMATPHVAGAAALVKQKNPSWSNVQIRNHLKNTATSLGSTNLYGSGLVNAEAATR

SEQ ID NO: 394 - protein, 876 aa, Artificial Sequence
  Synthetic construct intein-modified proSavinase_S317:Pfu_KlbA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGALYDFSVIQLSNGRFVLIGDLVEELFKKYAEKIKTYKDLEYIELNEEDRFEVVSVSPDLKANKHVVSRVWRRKVREGEKLIRIKTRTGNEIILTRNHPLFAFSNGDVVRKEAEKLKVGDRVAVMMRPPSPPQTKAVVDPAIYVKISDYYLVPNGKGMIKVPNDGIPPEKAQYLLSVNSYPVKLVREVDEKLSYLAGVILGDGYISSNGYYISATFDDEAYMDAFVSVVSDFIPNYVPSIRKNGDYTIVTVGSKIFAEMLSRIFGIPRGRKSMWDIPDVVLSNDDLMRYFIAGLFDADGYVDENGPSIVLVTKSETVARKIWYVLQRLGIISTVSRVKSRGFKEGELFRVIISGVEDLAKFAKFIPLRHSRKRAKLMEILRTKKPYRGRRTYRVPISSDMIAPLRQMLGLTVAELSKLASYYAGEKVSESLIRHIEKGRVKEIRRSTLKGIALALQQIAKDVGNEEAWVRAKRLQLIAEGDVYWDEVVSVEEVDPKELGIEYVYDLTVEDDHNYVANGILVSNSTYASLNGTSMATPHVAGAAALVKQKNPSWSNVQIRNHLKNTATSLGSTNLYGSGLVNAEAATR

SEQ ID NO: 395 - protein, 755 aa, Artificial Sequence
  Synthetic construct intein-modified proSavinase_S317:Pfu_Lon
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFSGEEVILIEKDGEKKVFKLREFVDGLLKEASGEGMDGSIRVVYKDLQGENIKILTKDGLVKLLYVNRREGKQKLRKIVNLEKDYWLALTPEHKVYTIKGLKEAGEITKDDEIIRVPLTILDGFDVAEKSIREELERLSLLPLNSEDSRLEKIAGIMGALFGSGGIDENLNTLSFVSSEKKTIEQFVKALSELFGEFDYKIEEKENSIIFRTCDKRIVTFFATLGAPVGDKSKVKLKLPWWVKLKPSLFLAFMDGLYSSNRNDKEILEITQLTDNVETFFEEISWYLSFFGIKAEAEEDEEKDKYRARLTLSSSIDNMLNFIEFIPISFSPAKREKFFKEIEKYLEYSIPEKTEDLKKRVKRVKKGERRNFLESWEEVEVTYNVTTETGNLLANGLFVKNSTYASLNGTSMATPHVAGAAALVKQKNPSWSNVQIRNHLKNTATSLGSTNLYGSGLVNAEAATR

SEQ ID NO: 396 - protein, 879 aa, Artificial Sequence
  Synthetic construct intein-modified proSavinase_S317:Pfu_RFC
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTGDTKVIANGQLFELGELVEKLSGGRFGPTPVKGLKVLGIDEDGKLREFEVQYVYKDRTDRLIKIKTQLGRELKVTPYHPLLVNRENGEIKWIKAEELKPGDKLAIPSFLPLITGENPLAEWLGYFMGSGYAYPSNSVITFTNEDPLIRQRFMELTEKLFPDAKIRERIHADGTPEVYVVSRKAWSLVNSISLTLIPREGWKGIRSFLRAYSDCNGRIESDAIVLSTDNNDMAQQIAYALASFGIIAKMDGEDVIISGSDNIERFLNEIGFSTQSKLKEAQKLIRKTNVRSDGLKINYELISYVKDRLRLNVNDKRNLSYRNAKELSWELMKEIYYRLEELERLKKVLSEPILIDWNEVAKKSDEVIEKAKIRAEKLLEYIKGERKPSFKEYIEIAKVLGINVERTIEAMKIFAKRYSSYAEIGRKLGTWNFNVKTILESDTVDNVEILEKIRKIELELIEEILSDGKLKEGIAYLIFLFQNELYWDEITEVKELRGDFIIYDLHVPGYHNFIAGNMPTVVHNSTYASLNGTSMATPHVAGAAALVKQKNPSWSNVQIRNHLKNTATSLGSTNLYGSGLVNAEAATR

SEQ ID NO: 397 - protein, 727 aa, Artificial Sequence
  Synthetic construct intein-modified proSavinase_S317:Pfu_TopA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLHPDTLILTSQGVRKIKELSREGEVFALDFNLKLSKAKYRLLERDADEQMYKVTLLDGTELYLTADHPVLVYREGNLAFVPADKLRETDHVVLVLNKSARDNYGFLDLLLEITDSQEDYAILENGETLSLHSLKMLVERGEIKDIAVVGFSHNNFGKVMLRDELWYLIGYLAGKGGEIKGNGVVISSRTKEIVGLTKSLNIDLIETEEGIVLSNKSFVRLLHLIHYTPRVPEVYGIINNTEWLKAFLAGYYDATLLEGLTLEALYKIKVYLQLLGIRAKIEDNKLKVHLEDLQRFRELLGKFSRRKLYVETSQVPVFTDFDERSYDFPRILGGDIYIIGIKSIEKFHYKGKVYDLVVENYHNFIANGIAVHNSTYASLNGTSMATPHVAGAAALVKQKNPSWSNVQIRNHLKNTATSLGSTNLYGSGLVNAEAATR

SEQ ID NO: 398 - protein, 614 aa, Artificial Sequence
  Synthetic construct intein-modified proSavinase_S317:Pho_CDC21-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHNSTYASLNGTSMATPHVAGAAALVKQKNPSWSNVQIRNHLKNTATSLGSTNLYGSGLVNAEAATR

SEQ ID NO: 399 - protein, 798 aa, Artificial Sequence
  Synthetic construct intein-modified proSavinase_S317:Pho_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHNSTYASLNGTSMATPHVAGAAALVKQKNPSWSNVQIRNHLKNTATSLGSTNLYGSGLVNAEAATR

SEQ ID NO: 400 - protein, 829 aa, Artificial Sequence
  Synthetic construct intein-modified proSavinase_S317:Pho_LHR
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGDSKVLTEKGPVEIRHLNSGMIVGINGFKSRFVKFQELHQVKYQEYGVKIRTQLGFEVKCTREHRFLTIDKNGELRWVEAWRLKEGDYVGIIRKLPSPNSKVLILDFLPESTYLWLNKEFLKKLKVSIKEKFGSIKNYAKERGFNSSYLVKQLNGLSPFRWGRLRVILNDVSIEISRDDIERITSRRGKYSLPPELTPGIARLLGFWMASGSLNRNTLIFYSQDKKILERYEDLCKREFRVKGRIKAQDKGTYILEIPSSLLSFVFKNLARPKLEVPPIIYILPEKHKEEFLAGYFDGNGFIKIENGRIHSLGFFAFNRKFAEGIRDILLQLGILSSINEQTFEVSIIEGEKFLKIVNSWRSNYYKEWEDVIPNLEKRLKEIEEKLGYPGTYNRREIRRSELKAIIKLYEKVARERGLNDVLKELSYLKELSEGDIFFDRITSIEPVYLDVAYGIINSETGNYVVNGFVSKNSTYASLNGTSMATPHVAGAAALVKQKNPSWSNVQIRNHLKNTATSLGSTNLYGSGLVNAEAATR

SEQ ID NO: 401 - protein, 828 aa, Artificial Sequence
  Synthetic construct intein-modified proSavinase_S317:Pho_Lon
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFSGEEVIIVEKGKDRKVVKLREFVEDALKEPSGEGMDGDIKVTYKDLRGEDVRILTKDGFVKLLYVNKREGKQKLRKIVNLDKDYWLAVTPDHKVFTSEGLKEAGEITEKDEIIRVPLVILDGPKIASTYGEDGKFDDYIRWKKYYEKTGNGYKRAAKELNIKESTLRWWTQGAKPNSLKMIEELEKLNLLPLTSEDSRLEKVAIILGALFSDGNIDRNFNTLSFISSERKAIERFVETLKELFGEFNYEIRDNHESLGKSILFRTWDRRIIRFFVALGAPVGNKTKVKLELPWWIKLKPSLFLAFMDGLYSGDGSVPRFARYEEGIKFNGTFEIAQLTDDVEKKLPFFEEIAWYLSFFGIKAKVRVDKTGDKYKVRLIFSQSIDNVLNFLEFIPISLSPAKREKFLREVESYLAAVPESSLAGRIEELREHFNRIKKGERRSFIETWEVVNVTYNVTTETGNLLANGLFVKNSTYASLNGTSMATPHVAGAAALVKQKNPSWSNVQIRNHLKNTATSLGSTNLYGSGLVNAEAATR

SEQ ID NO: 402 - protein, 814 aa, Artificial Sequence
  Synthetic construct intein-modified proSavinase_S317:Pho_Pol_I
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSILPDEWLPIVENEKVRFVKIGDFIDREIEENAERVKRDGETEILEVKDLKALSFNRETKKSELKKVKALIRHRYSGKVYSIKLKSGRRIKITSGHSLFSVKNGKLVKVRGDELKPGDLVVVPGRLKLPESKQVLNLVELLLKLPEEETSNIVMMIPVKGRKNFFKGMLKTLYWIFGEGERPRTAGRYLKHLERLGYVKLKRRGCEVLDWESLKRYRKLYETLIKNLKYNGNSRAYMVEFNSLRDVVSLMPIEELKEWIIGEPRGPKIGTFIDVDDSFAKLLGYYISSGDVEKDRVKFHSKDQNVLEDIAKLAEKLFGKVRRGRGYIEVSGKISHAIFRVLAEGKRIPEFIFTSPMDIKVAFLKGLNGNAEELTFSTKSELLVNQLILLLNSIGVSDIKIEHEKGVYRVYINKKESSNGDIVLDSVESIEVEKYEGYVYDLSVEDNENFLVGFGLLYAHNSTYASLNGTSMATPHVAGAAALVKQKNPSWSNVQIRNHLKNTATSLGSTNLYGSGLVNAEAATR

SEQ ID NO: 403 - protein, 526 aa, Artificial Sequence
  Synthetic construct intein-modified proSavinase_S317:Pho_RadA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFARDTEVYYENDTVPHMESIEEMYSKYASMNGELPFDNGYAVPLDNVFVYTLDIASGEIKKTRASYIYREKVEKLIEIKLSSGYSLKVTPSHPVLLFRDGLQWVPAAEVKPGDVVVGVREEVLRRRIISKGELEFHEVSSVRIIDYNNWVYDLVIPETHNFIAPNGLVLHNSTYASLNGTSMATPHVAGAAALVKQKNPSWSNVQIRNHLKNTATSLGSTNLYGSGLVNAEAATR

SEQ ID NO: 404 - protein, 764 aa, Artificial Sequence
  Synthetic construct intein-modified proSavinase_S317:Pho_r-Gyr
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTPDTLVSLSDGRIIEIREAVENSEESLLGINGLKPKEAKALKFWEIDWDGPIKVIKLKNGHEIKATPDHGLLVMRDGKIGWVSAKNIREGDYVAFIYNLGHRGGKKYTLPQLLKELGISEYENSSSQELNNREQEMDSKQISIELDERFWYIFGVILGKGTLKGDKVVIFQKDVKPVIEEALPFVRIFESADHIGFSHLILAEVFRRLGVGEGKLHSLVFGLREEYINAMIAGYFDASGTFLRRAVLTSKRGDILRMLSVYLYQIGIVNNLRRDEHAGVWELIISDLEKFREKIYPYLRIKKSQFDKVYSISKNEGDFLPVASIFRKLKFRDGFKNRILDEEIPRDEVAKVLEYAEDSPEKEFLNSLVEARVTWVRVEKIEERHYTGKLYDFTTTTENFISNGIVSHNSTYASLNGTSMATPHVAGAAALVKQKNPSWSNVQIRNHLKNTATSLGSTNLYGSGLVNAEAATR

SEQ ID NO: 405 - protein, 744 aa, Artificial Sequence
  Synthetic construct intein-modified proSavinase_S317:Pho_RtcB_Pho_Hyp-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAPGTRVLTEHGYWLKIEEMPEKFKLQRLRVYNIEEGHNDFSKVVFVAEREVGSEEKAIRIVTESGKVIEGSEDHPVLTPEGYVYLRNVKEGDYILVYPFEGVPYEEKKGVILDESAFEGEDPQVVKFLRERNLIPLQWKDPKVGILARILGFALANGYISENDNLTFHGKEEVLREVRKDLEELGIEAIVAEEDKLKVTSREFAFLLEKLGMAHDSIPEWIIEGPLWIKRNFLAGLFGANGSIVEFKGDVPLPITLTHSRELLNDVSRILEGFKVRAKIKMGKNGSYQLVIEDEDSIRNFLGRINYEYDPEKKARGLIAYAYLKFKELMKGNLMTFEEFARDRGYEGGFVAEKVIEVKSVKPEYDKFYDIGVYHSAHNFIANGIVVHNSTYASLNGTSMATPHVAGAAALVKQKNPSWSNVQIRNHLKNTATSLGSTNLYGSGLVNAEAATR

SEQ ID NO: 406 - protein, 730 aa, Artificial Sequence
  Synthetic construct intein-modified proSavinase_S317:Pho_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVDGDTLVLTKEFGLIKIKELYEKLDGKGRKIVEGNEEWTELEKPITVYGYKDGKIVEIKATHVYKGVSSGMVEIRTRTGRKIKVTPIHRLFTGRVTKDGLILKEVMAMHVKPGDRIAVVKKIDGGEYIKLDSSNVGEIKVPEILNEELAEFLGYLMANGTLKSGIIEIYCDDESLLERVNSLSLKLFGVGGRIVQKVDGKALVIQSKPLVDVLRRLGVPEDKKVENWKVPRELLLSPSNVVRAFVNAYIKGKEEVEITLASEEGAYELSYLFAKLGIYVTISKSGEYYKVRVSRRGNLDTIPVEVNGMPKVLPYEDFRKFAKSIGLEEVAENHLQHIIFDEVIDVRYIPEPQEVYDVTTETHNFVGGNMPTLLHNSTYASLNGTSMATPHVAGAAALVKQKNPSWSNVQIRNHLKNTATSLGSTNLYGSGLVNAEAATR

SEQ ID NO: 407 - protein, 728 aa, Artificial Sequence
  Synthetic construct intein-modified proSavinase_S317:Pna_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTADTRLATQHGLVPIGWLQANGGALDCTVDRRALGEDRRGTVTRAAVPAFLSAGQAEVFKVTTAEGYQIKATAWHEFYTARGKLKLSELKAGDELWVQSGKGQFGAQGSGALGLLIGLITGDGHFTNRGKDEQAAVISLWGEERQLADDIAGSVNALIAGTSLAPRDYLVKPVAVAERNMVFIRSTMLVRVLDGYGFNGETKLEVPEVVWRGSEACMRGYLQGLFQTDGTVNVSSNSQSCSVRLSSSHRPLLQDVQVLLANFGVFSRIHERREAGPRSLPDGQGGQRDYLCQTQHELIVDGESREAFMREIGFLLPAKREKYDAWVADKALVKTQRFAATITAIEPAGVEPVYDTTQPDGNTVIFNGLVTGQSTYASLNGTSMATPHVAGAAALVKQKNPSWSNVQIRNHLKNTATSLGSTNLYGSGLVNAEAATR

SEQ ID NO: 408 - protein, 810 aa, Artificial Sequence
  Synthetic construct intein-modified proSavinase_S317:Pno_RPA2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLSADHEVLTSTGWKALPAIKDADQVMTLDLQTGTQQWNSVQATTRFAREGSLYRLKSDDMDAVCNESHRWYLNTKDQPTTYTAFTTQQMLDNQLVALRNSSGKATDQWNHESGTTTHTNHNIPTVGHNGNVMFSWPDCPWLPREFVADEACNLDWCRFIGLVMGDGSIDHVTDAQGQEHYSIQIHQRAGNPASNANTEDVLERLAAKLPNFVVHPSCVSGAEEKHTWTINHRDMYHFFLPMMRGPQSYDPLDNAMCRTYQAPDYQALSRSDNEPIIPVPADWKTGNWWHLRRWINYPWLFSLAQSQARAMIKGMAAANGDWSLSLKARLDTGDSGVVRVFSNSIPLMHDMSVLGLLADTRVNIGVDHKKGQMQLQVPVTMPALLAWCISFSFANSDLAVAAPKPEAYDNPRHDGFVYCLTVPNGNFLARRTVEYSDNDKIQEVIDAAQKPFFTGNSTYASLNGTSMATPHVAGAAALVKQKNPSWSNVQIRNHLKNTATSLGSTNLYGSGLVNAEAATR

SEQ ID NO: 409 - protein, 734 aa, Artificial Sequence
  Synthetic construct intein-modified proSavinase_S317:Posp-JS666_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTADTWVMTTAGPAQVSELTGRSFSAVVDGKAYAVTSDGFFRTGHKPVLALRTREGPALRLTADHRVRRVARRTRYTLEAEWTEAGQLQPGDEILLHDHRALGGWEGAGTHAEGYLLGLLIGDGTLKSDKAVISVWAPELKVAGGGAVAYAQTGAGGIVQAAEAAAATLSHRVDFRGFQRSISGRGEARMASGAVRHLAHEMGMRPGHKTITTAMEKASSVFTEGLLRGLFDADGSVQGSQEKGVSLRLSQSDLSLLQTAQRMLLRLGIASTIYPNRRLAQARPLPDGRGGLRVYETASQHELVISADNLRIYAERIGFADTDKADRLDQALGSYNRSLNRERFTVTVESLTEEGSEDVFDVTVADIHAFDANGLYVHNSTYASLNGTSMATPHVAGAAALVKQKNPSWSNVQIRNHLKNTATSLGSTNLYGSGLVNAEAATR

SEQ ID NO: 410 - protein, 720 aa, Artificial Sequence
  Synthetic construct intein-modified proSavinase_S317:PP-PhiEL_ORF39
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGAGVLSSKIKIPGGWKTMGNIRVGDEVVTPDGGTAKVLAVHPQGVTKVVRVHFKDGRYTDVSPDHLWKVRRHHWCNDKAMAKLTREEVEERVWRVITTNELKDYIGLSTKVYVQLIEPERNADKPFKIHPYVLGVLLGDGCISQKAVDITKPYQQLFDKVQSLLPEHLECVWRPNRKGDGEPKTFGIRFKDRRSEQHINWHIRDGLKELGLYGMRSWGKVIPEEYLHGSAKQRLELLQGLLDTDGTVDKHKSVSFSSSSKLLSLGVQYLVRSLGGMARLQERTPHYTHNGEKREGRTDYRVYIRYPRPEELFTLDHKRERAVSHQHTETLRLQVTHIEERPDEETQCITIDHPDHLYITDDFIVTHNSTYASLNGTSMATPHVAGAAALVKQKNPSWSNVQIRNHLKNTATSLGSTNLYGSGLVNAEAATR

SEQ ID NO: 411 - protein, 803 aa, Artificial Sequence
  Synthetic construct intein-modified proSavinase_S317:Pst_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAKGTKVLMANGDDKNIEDIAVGEEVLGKDGLPREVVALPRGRETMYEVSEKTQHRAETVFGTASYTCNATHKLVLQTNQRVNITNHVLRGESQTSVTYFQMKTAVADGREIELPKLCTKSFQHSSHGRENAWKKAEVFASTISRDPIDWTAEARDISRLGYHVRRATRQLWSPVLVEKEVLAPMIAKRGFDESIAPYMAYLVGLWVGDGYSDRATFSIDIQDVEIHERIKDFASHAGLTPRIACYKKSRDATISLHNSETRGKNVRQNLNTGNLLWSLLAEICGKKENEMLFKLVPSFLRSESIAVREYFISGLVDSDGHVKRDEADKCYSATVKTIYPAVRDGLVSVARSLGIQTSVSVEEAKEVNSVKHQESYAIYMANSSALDSVLSKCAAPRKRAEEPVCVNREPHPYTFHMVEKEEDDFYGITLSEDSDHQFLLSNLALVHNSTYASLNGTSMATPHVAGAAALVKQKNPSWSNVQIRNHLKNTATSLGSTNLYGSGLVNAEAATR

SEQ ID NO: 412 - protein, 782 aa, Artificial Sequence
  Synthetic construct intein-modified proSavinase_S317:Rma_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAGDTLITLADGRRVPIRELVSQQNFSVWALNPQTYRLERARVSRAFCTGIKPVYRLTTRLGRSIRATANHRFLTPQGWKRVDELQPGDYLALPRRIPTASTPTLTEAELALLGHLIGDGCTLPHHVIQYTSRDADLATLVAHLATKVFGSKVTPQIRKELRWYQVYLRAARPLAPGKRNPISDWLRDLGIFGLRSYEKKVPALLFCQTSEAIATFLRHLWATDGCIQMRRGKKPYPAVYYATSSYQLARDVQSLLLRLGINARLKTVAQGEKGRVQYHVKVSGREDLLRFVEKIGAVGARQRAALASVYDYLSVRTGNPNRDIIPVALWYELVREAMYQRGISHRQLHANLGMAYGGMTLFRQNLSRARALRLAEAAACPELRQLAQSDVYWDPIVSIEPDGVEEVFDLTVPGPHNFVANDIIAHNSTYASLNGTSMATPHVAGAAALVKQKNPSWSNVQIRNHLKNTATSLGSTNLYGSGLVNAEAATR

SEQ ID NO: 413 - protein, 726 aa, Artificial Sequence
  Synthetic construct intein-modified proSavinase_S317:Rsp_Rir1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTAETWVMTDEGARQVSALLDRPFRAVVNGIAYDSGEHGFFCTGLKPVKRLSTACGRHLRLTADHLVRKVVGKTRWRQEVEWVPAGDLRPGDEVKLHDHRTAMIQTRPEDERGYLLGLLIGDGVIRDDKTLISVWPQEECIGAQPLGHPVMHKVEALLRDLPHRADFAGWQKVEGRGEYRIGTAALTALAAEYGLTRGRKTITPEIEGAETAGFGAAVLRGLFDADGSVQGAQEKGVSVRLAQSDLALLQAAQRMLARLGMNAVIYENRREAGRAFLPDGKGGQAHFETKAQHELVISGENLATYQERIGFTDVAKARRLAVALSGYKRALNRERFSAVVADVVDDGMAEVFDVQVPGVNAFDANGFYVHNSTYASLNGTSMATPHVAGAAALVKQKNPSWSNVQIRNHLKNTATSLGSTNLYGSGLVNAEAATR

SEQ ID NO: 414 - protein, 702 aa, Artificial Sequence
  Synthetic construct intein-modified proSavinase_S317:SaP-SETP3_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLKRGTEVIMFDGTTKKVEDVIVGDVLMGPDSTPRNVLSLGRGREMMYEVKPRKGESYTVNESHILSLRTTTGIAKGSWPDNTVFDISVRDWLKLPKYVTGPNGYLKGWRVPVDFPRKEQDEALLPPYLMGLWLGDGTSSSGAITSGENEKEIRAYLESYAARNGMQIRKEGLTWSISHGNTGHKKHGFTHALKSAGVLNNKHIPHNYKCGDRRQRLELLAGLLDSDGYCDLSKAGFDWISVSERLADDFCYLCRSLGFAAYKKKTCKRCANTDVWGDYFRVSVSGDFSEVPFVRGRHQNLPKRNINKNVLNVGIESITPVGVDDYFGFTIDGDSRFLLGDFTVTHNTSTYASLNGTSMATPHVAGAAALVKQKNPSWSNVQIRNHLKNTATSLGSTNLYGSGLVNAEAATR

SEQ ID NO: 415 - protein, 692 aa, Artificial Sequence
  Synthetic construct intein-modified proSavinase_S317:Sav_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGAQPLDSLVLAPTGFRRMGDLREGDEVVVPNGEIALIDGVFPQGVRDVWRIVLSDGSSVECDDEHLWIVGTSCGWHRGQTPKVMTTREIRLDTFKANGSSKWYVPAATPVDLGPDVGLPLDPYLFGLLLGDGSFRHNLRLSTVDDEIRDAAADAVAPDCRLVPVTGSRCDYTIQLKQRSGGVRNPVIQALRRLDLWGKTSHGKFIPEDFKNTSIKNRLSLLQGLLDTDGTVHADGMSVSLRSASLRLAEDVAWLVRSLGGRARVLPEKAAFHVSVALPDEYAPFRLSRKADRVRPRPKYNTFRRGIRAVEYVGRKPAQCISVGHPSHAYVTDNFTVTHNSTYASLNGTSMATPHVAGAAALVKQKNPSWSNVQIRNHLKNTATSLGSTNLYGSGLVNAEAATR

SEQ ID NO: 416 - protein, 853 aa, Artificial Sequence
  Synthetic construct intein-modified proSavinase_S317:Sex-IFO1128_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAKGTQVMMADGSDKSIEDIQLGENVMGKDGTPRTVISLPRGKETMYEVCHSSTKGTTKDTLMNYVCSGNHKIVMQTPQQIGITEHGIDGKTYTSVSYFALRDSQHGYPIVKKLTKSFEHQQHGGKEQTLITVNNFVSSLKSEPINWDVEAKHYESLGHYVKKCSYQLINPVFHQSGKLAQEIASLNYSKDKAPLLAWLIGFWVGNGAMRHSQFVVESQDIELVNRIQDIAGLLNLSATTACYYSGSKDDEAKLAKLNSSSAEGFEDDLEGNPSVKELADMDRLSESKTATLPTAFGVENIDELIISLGEGRGNGNVFAQVIGSFGIDLADKDTLVTKIAHELAGDAFEVREQFVAGLVDAAGYVRKDVYDHASEATISTESKSTVLGLVKIARSLGIKITVTSDDSDDSDEHDHAHCGHDHGSSSSYTAVMTGDALTNSMRFCAIGRNRVAAKEFMRQAVPFYFSLEKKSEDDYYGITVPDNTDKQYLLSSMALVHNSTYASLNGTSMATPHVAGAAALVKQKNPSWSNVQIRNHLKNTATSLGSTNLYGSGLVNAEAATR

SEQ ID NO: 417 - protein, 834 aa, Artificial Sequence
  Synthetic construct intein-modified proSavinase_S317:Smar_1471
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSVSYDTPVLIRDPINKIHLVKIGEFIDKFYEEGEERTAKHVNGYYVLSHDGFQVVWKPIKYVLRHRTNEIYEIIYEGGGKLEATGSHSVFVLDPDTLDIVEKPVMLLNKGEYLVSFNGVKENKDHQTIDLIDLVSDYNDVYVDNIPSELKKHTGGRNPIPLKQYMILRKRVITKKNNSLIKLRRSKYTLPIRLVLDEKLAFLFGAYIANGCVKERRDKLICFTFGKSAKNIADKVMNIMYEKFNIKPFIDDRGTYIIYEYPHTLLAIIFEKLLGRKLEEKKMPEILWSSPKSVIRAFFEGLRAYSQRTLRRRYTSYTTANKNLAYQLLWLARFAGFYSVLKEEKEAGKNNGKTYYHVIVYLDQSYRKPNASERVPVKPILKLIKYTKPRTMPPELAYIKRREFISRKTALKALEWIRRDGSFTDFSREYLRKIESLINGDIIVLKIKDVRKKQYKGYVYDISVPITEAFFGGNIPILLHNSTYASLNGTSMATPHVAGAAALVKQKNPSWSNVQIRNHLKNTATSLGSTNLYGSGLVNAEAATR

SEQ ID NO: 418 - protein, 704 aa, Artificial Sequence
  Synthetic construct intein-modified proSavinase_S317:Smar_MCM2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSYHKDFKIMLADGRKVRIGDLVDELIGKNREKVIKGKDTEILFVDDLFLLSYNMRSGEQVLVKADRVSRHKAPDQFIKLRFSNGAEIIVTPEHPVLIINNGKIKTVRADTVRKGTLTIGVLGHKIIKEVNEDDIINNIRRKIVLDKELPYIHAKNISEAVEMRDQLMSIDIPTFIVKHKNEIRLYPSGPCSLRRLLLMHGVEEVVFSDELLYEIMNCHLYPATWYELLYSMGLTKIAKELNVYDFEILAGIIKKVEKEVIMLSQVLGLRNETQTELLHLKSRRELLIRLKDKLDMLRKRLKDLEEALGKDAVIRMITDVEVIKNTDSDWVYDITIEPYHLFVSDGLILHNSTYASLNGTSMATPHVAGAAALVKQKNPSWSNVQIRNHLKNTATSLGSTNLYGSGLVNAEAATR

SEQ ID NO: 419 - protein, 698 aa, Artificial Sequence
  Synthetic construct intein-modified proSavinase_S317:Sru_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLGKGTPVMMYDGRTKPVEKVEVGDRLMGDDGSPRTVQSLARGREQMYWVRQKRGMDYRVNESHILSLKKSRREGARDRGSIADISVRDYLDQSDKWKDDNKGFKVAAEFPDQPVPLDPYFLGLWLGDGKSDNARIYTTDEEVITGLQEIAEKRGDTISVSDEHRRCPAYLVKSGDRGGAMATRESVQGALRALGVLGDKHIPHLYLGNSRGKRLRLLAGLIDSDGHLNDGHGGTYEITQSSEQLARDIKFLCDTLGYRTSLTQKTARISSTGYESEVHRVRFNGNVDEIPVRVERKKASPWTDVRDWRMTGIDVEPDGVGDYFGFTLDGNGRFLLGDGTVTHNSTYASLNGTSMATPHVAGAAALVKQKNPSWSNVQIRNHLKNTATSLGSTNLYGSGLVNAEAATR

SEQ ID NO: 420 - protein, 712 aa, Artificial Sequence
  Synthetic construct intein-modified proSavinase_S317:Sru_PolBc
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFDPETEVVTVDGIRHVEEIEVGDRVYSLNPDTGAVEIKPVTATQSQHYAGPMVEIKNQHTDFLVTPNHRFLTQRFTSGEYTDLEWETAGDMLGDRIRRRLPSLRSLPATQERPGPISLSAVCDRLAIEHKTGPRGIKELRRQARWQPEEYELTDWLRILGWFATEGTLYKSKARQYENGNVRGVSYQTTLCQKNDIGRSEIATLLNRTGITYSSDQNDHSFCSKVLYEILEAECGSDSFSKHLPPWIFQLGPKDLKIVFDTLMQGDSAANGDRFTTSSNQLAEDFIRLAMHIGRRAFHMPNDGSHRIQVNTVRGQRPTIKPKHRQQVDYDGMIHCLTVADNHTVLAGRNRKFNWTGQSTYASLNGTSMATPHVAGAAALVKQKNPSWSNVQIRNHLKNTATSLGSTNLYGSGLVNAEAATR

SEQ ID NO: 421 - protein, 783 aa, Artificial Sequence
  Synthetic construct intein-modified proSavinase_S317:Ssp_DnaB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCISGDSLISLASTGKRVSIKDLLDEKDFEIWAINEQTMKLESAKVSRVFCTGKKLVYILKTRLGRTIKATANHRFLTIDGWKRLDELSLKEHIALPRKLESSSLQLMSDEELGLLGHLIGDGCTLPRHAIQYTSNKIELAEKVVELAKAVFGDQINPRISQERQWYQVYIPASYRLTHNKKNPITKWLENLDVFGLRSYEKFVPNQVFEQPQRAIAIFLRHLWSTDGCVKLIVEKSSRPVAYYATSSEKLAKDVQSLLLKLGINARLSKISQNGKGRDNYHVTITGQADLQIFVDQIGAVDKDKQASVEEIKTHIAQHQANTNRDVIPKQIWKTYVLPQIQIKGITTRDLQMRLGNAYCGTALYKHNLSRERAAKIATITQSPEIEKLSQSDIYWDSIVSITETGVEEVFDLTVPGPHNFVANDIIVHNSTYASLNGTSMATPHVAGAAALVKQKNPSWSNVQIRNHLKNTATSLGSTNLYGSGLVNAEAATR

SEQ ID NO: 422 - protein, 789 aa, Artificial Sequence
  Synthetic construct intein-modified proSavinase_S317:Ssp_GyrB
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFSGDTLVALTDGRSVSFEQLVEEEKQGKQNFCYTIRHDGSIGVEKIINARKTKTNAKVIKVTLDNGESIICTPDHKFMLRDGSYKCAMDLTLDDSLMPLHRKISTTEDSGITIDGYEMVWSPRSDSWLFTHLVADWYNRWQGIYIAEEKQHCHHKDFNKRNNNPDNLIRLSPEKHLALHRKHISKTLHRPDVVEKCRRIHQSPEFRRKMSARMQSPETRAILSKQAQAQWQNETYKLTMMESWRSFYDSNEDYRQQNAEQLNRAQQEYWAQAENRTAQAERVRQHFAQNPGLRQQYSENAVKQWNNPELLKWRQKKTKEQWTPEFREKRREALAQTYYRKTLAALKQVEIENGYLDISAYDSYRISTKDKSLLRFDRFCERYFENDENLAREAVLNYNHRIVNIEAVSETIDVYDIEVPHTHNFALASGVFVHNSTYASLNGTSMATPHVAGAAALVKQKNPSWSNVQIRNHLKNTATSLGSTNLYGSGLVNAEAATR

SEQ ID NO: 423 - protein, 774 aa, Artificial Sequence
  Synthetic construct intein-modified proSavinase_S317:StP-Twort_ORF6
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCISMDSMILTTEGYKSLQEIFETQGVKVDNKEKVIELKYPLINRYGDVEYTSHFTKNGEKPTKRIKTNKGIELVNTYNHPLLVREGFNLIWKKSEDIEVGDILVSRVGDHQFGNNNTVENEEEAYALGCMVADSYLGSYSRLSFSNDKKEILDKVSKFWNTFSNKEVYYDTYKESKGITIHLHDTNKTKEFHDKYKIEYGVAKDKKIPKCIMESPENIQLAFVSGYLECESSISEKNLEVTSASKDLLKDLQLILSNIGIVSTNKEKVVKKYKHNKYYRLIVNRKELIKLLPLLRFETQQRKNQKENFLSNNTKIKSSYGNTIEGSRYLLKKYRDSLNIDKKEFSKYLSRDTITIDRLREVISLYPDGDKEIRELFENVVNNNIYYQKVEQVLEGEIIPTFDVCMPKTHSFIANTIVNHNSTYASLNGTSMATPHVAGAAALVKQKNPSWSNVQIRNHLKNTATSLGSTNLYGSGLVNAEAATR

SEQ ID NO: 424 - protein, 714 aa, Artificial Sequence
  Synthetic construct intein-modified proSavinase_S317:Tag_Pol-1_Tsp-TY_Pol-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCHPADTKVIVKGKGIVNISDVKEGDYILGIDGWQRVKKVWKYHYEGKLININGLKCTPNHKVPVVTENDRQTRIRDSLAKSFLSGKVKGKIITTKLFEKIAEFEKNKPSEEEILKGELSGIILAEGTLLRKDIEYFDSSRGKKRISHQYRVEITIGENEKELLERILYIFDKLFGIRPSVKKKGDTNALKITTAKKAVYLQIEELLKNIESLYAPAVLRGFFERDATVNKIRSTIVVTQGTNNKWKIDIVAKLLDSLGIPYSRYEYKYIENGKELTKHILEITGRDGLILFQTLVGFISSEKNEALEKAIEVREMNRLKNNSFYNLSTFEVSSEYYKGEVYDLTLEGNPYYFANGILTHNSTYASLNGTSMATPHVAGAAALVKQKNPSWSNVQIRNHLKNTATSLGSTNLYGSGLVNAEAATR

SEQ ID NO: 425 - protein, 892 aa, Artificial Sequence
  Synthetic construct intein-modified proSavinase_S317:Tag_Pol-2_Tsp-TY_Pol-2_T134
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSILPNEWLPIIENGEVKFVKIGEFIDRYMEEQKDKVRTVDNTEVLEVDNIFAFSLNKESKKSEIKKVKALIRHKYKGEAYEVELNSGRKIHITRGHSLFTIRNGKIKEIWGEEVKVGDLIIVPKKVKLNEKEAVINIPELISKLPDEDTADVVMTTPVKGRKNFFKGMLRTLKWIFGEESKRIRTFNRYLFHLEELGFVKLLPRGYEVTDWEGLKRYRQLYEKLVKNLRYNGNKREYLVRFNDIKDSVSCFPRKELEEWKIGTRKGFRRKCILKVDEDFGKFLGYYVSEGYAGAQKNKTGGMSYSVKLYNENPNVLKDMKNIAEKFFGKVRVGKNCVDIPKKMAYLLAKSLCGVTAENKRIPSIIFDSSEPVRWAFLRAYFVGDGDIHPSKRLRLSTKSELLANQLVFLLNSLGVSSIKIGFDSGVYRVYINEDLPFLQTSRQKNTYYPNLIPKEVLEEIFGRKFQKNITFEKFKELADSGKLDKRKVKLLDFLLNGDIVLDRVKNVEKREYEGYVYDLSVEDNENFLVGFGLLYAHNSTYASLNGTSMATPHVAGAAALVKQKNPSWSNVQIRNHLKNTATSLGSTNLYGSGLVNAEAATR

SEQ ID NO: 426 - protein, 2340 aa, Artificial Sequence
  Synthetic construct intein-modified proSavinase_S317:Ter_DnaB-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCAAYDTLVLQKDGSLVTLAEVYKRQEIELLTLGKNSKFYLTKPSAFIDDGIKPIFRVTTKLGRFVETTITHPFLTVNGWKPLSKLQVGEKIAVPRRLNIFGNETISESKFSSLINFDNLYLFPLVFQLERSQLALFIRYLFSLDGWVKIYQNKIVCFGYSTVSEKLIRQIQHILLRFGIVSGIEKFEEKRTEKIKVVKEVKSQRSHREEFTFATYRNCYCDGKWHLTITDALSQKNLMEDIGGFDSKNFYLFDLLQPHNSGNQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTAKGKSPKNSENLTTTETICRKNILANMENLPSDNQNFDSEKLDLSQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLSQPHNSGTQELENHLIFWDELVNVLAKFAASKNQSLKNRTTKRNSPKNSENLTTTETICRKNILANMENLPSDNQNFDSEKLDLPQPHNSGTQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFAASKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTAKGKSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGNQELENHLIFWDELVNVLAKFATSKNQSLKNRTTKRNSPKNSENLTTTETICRKNILANMENLPSDNQNFDSEKLDLPQPHNSGTQELENSDIFWDKIVSIEPVGEKQVYDLTVPETHNFVANDICLHNSTYASLNGTSMATPHVAGAAALVKQKNPSWSNVQIRNHLKNTATSLGSTNLYGSGLVNAEAATR

SEQ ID NO: 427 - protein, 782 aa, Artificial Sequence
  Synthetic construct intein-modified proSavinase_S317:Ter_DnaE-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLSGSTKVIDAATGNLFSLKEIAAQPEYWLSRKVFSLDLKSQQVVQQPITEIHPNGVRDVWQITTRTNRKVCATDDHLFYTVLGWKPLKDFSVGDRLGLPNKIPINYRSQISDSKVKFTAYLIGEGYLYTNSFSCSYFCNSDGELIADFYGCAEELFGSSAPIEKQLHLGNKSVIYVRIGLISGLKNWVDSYLQCANSRVQEIPNWIFSLSQSQLQLFLGILWSTSGIFDETIGYTYYSSNSEVLVRQVQHLFLRLGIVSLFNVNKVKGQGELDVSYVVEVRGREDMLKFYKLIKPYLSSYKQGLCESCYLVIKYQQSYQFKYFLTPDFFDLIVKAKKASSMTRALGVCGGEISSVWNFQNTSNRSLSFDKFNNFSTVLADEELTAIANSDVFWDEIISIEYIGKEEVFDLTIPETHNFIANDFIVHNSTYASLNGTSMATPHVAGAAALVKQKNPSWSNVQIRNHLKNTATSLGSTNLYGSGLVNAEAATR

SEQ ID NO: 428 - protein, 491 aa, Artificial Sequence
  Synthetic construct intein-modified proSavinase_S317:Ter_DnaE-3nc_NC-terminal
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTYETEIMTVEYGPLPIGKIVEYRIECTVYTVDKNGYIYTQPIAQWHNRGMQEVYEYSLEDGTVIRATPEHKFMTEDGQMLPIDEIFERNLDLKCLGTLEMVKIVSRKLAKTENVYDIGVTKDHNFVLANGLIASNSTYASLNGTSMATPHVAGAAALVKQKNPSWSNVQIRNHLKNTATSLGSTNLYGSGLVNAEAATR

SEQ ID NO: 429 - protein, 784 aa, Artificial Sequence
  Synthetic construct intein-modified proSavinase_S317:Ter_Ndse-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSLTGDQKVLYYIAKKLYYETFAECYDRINGDISSVSVPCFDENYQTVIKPISAIWKHHVKKKGFKIKITWGKQIKITEDHSLFTRNENNKPQAVFGNEIKVGDEIGIPSYISFLEQPLEPFHITDKILIQEEIYVESEDTISYIEKYGDKMREYLLAKSLSPSQFYSILKTYEAKNQIPWHLWKYLELPLSEKDKVCYLSKKAIKNWIDNVEELLWFLGFYVARGSLIKNEVVLKGEPSQLEKVIELIERIFEYKSEINDSGYISIKSKILVDLIGYGLNFGNQEKDIPNWILQLPEQQLIRFLKGFVAGNNLENQLNFYLEFKTDSQLVAEKLVLILSKFGLVADVSEIEVNEEDIAKIYRIIIEGLEDKNIHNLSKVEQKISALTTGDIAWGKIESIEEFEIDDYVYDFSVPNYENFIGGSYNVFAHNSTYASLNGTSMATPHVAGAAALVKQKNPSWSNVQIRNHLKNTATSLGSTNLYGSGLVNAEAATR

SEQ ID NO: 430 - protein, 677 aa, Artificial Sequence
  Synthetic construct intein-modified proSavinase_S317:Ter_RIR1-3
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGDTLLITRDSIHKIKDVVGQKIEIWNGKNWSQVIPLKTGKDRKLYRVRFGDGSYLDVTEYHRFFVKDRFGKKYEEVQTKDLLTHSKYALDVEPFIIDYHDGDSINLSYAYTLGAALGNGTIDQNSNGKIRVYSHKAELIFAGNKSLERQYNYLPSFVDVIDLGFSGELLRRLQTEPDALNTIASWNKSAILAFIAGLADTDGSETKGNGIKISVSDYERAKRLQLLLTKCGIRASVNLMASRGCTTNLGERNQDLYYLQITDCREIPCQRLDTTKVCEAKFQGKYQTIQNVEELPGLHDTYCFEEPEFHKGVFGNALTGNSTYASLNGTSMATPHVAGAAALVKQKNPSWSNVQIRNHLKNTATSLGSTNLYGSGLVNAEAATR

SEQ ID NO: 431 - protein, 735 aa, Artificial Sequence
  Synthetic construct intein-modified proSavinase_S317:Ter_RIR1-4
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLDKTALRIFNQGLLYADEVVTPGSGETVGLGLTVRNGIGASTAIANQPMELVEIKLANGRKLRMTPNHRMSVKGKWIHACNLKPGMLLDYSIGEYQKREDTLLIPLQLEDYTEVNNSQTLGHNGGVLTKKIMTPASMTSDLAYFLGCLFGNGCIVQNKYQVCFYHSRLDVLYGLQEKGKKLFGIKGSLNDFANGRFELCFASRQLFYWLHLNQLVKTQKSEDLERIPLSLRRSSRVTLLSFFCGLIDTNGYVPQDGKLSIASASSDFIHNLQQIGESIGLCFSIYQNTKGENLQNQHNNTWGLCLSPMLSNVDALDYLNHNSIKCQEGPVVISKCVLNYSPYKIESVNIGAVCDYSYDFAIEGINDNDSWYWQGALKSHNSTYASLNGTSMATPHVAGAAALVKQKNPSWSNVQIRNHLKNTATSLGSTNLYGSGLVNAEAATR

SEQ ID NO: 432 - protein, 823 aa, Artificial Sequence
  Synthetic construct intein-modified proSavinase_S317:Ter_Snf2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVLHDTEIYVNGMVMEAEQIWQAYAGEAEFDGEGFWTEPNKELLVNSLDETTGKIVFARIRRLYRQWVREKLRKVRLKDGSSITITCRHKLFIRDSWKNDFQVGDDVCVPAKLMWDGKPEDPDVVKFVAWQVAEGWERVNSGMFGVSQKGKDVLEGLLEVFSRLGKRYDIKINCPKVVAHGSKKNCYEFSAHSLEYRKFLEEKRYGWGKRSHEKTIPLFIMQADLDSVRVFLSNYFDAEGWVNKTVRCVEISTASSQLIQELSILLRRFGVWMKISPQQKCATNGTGVFCTYYIGTFGGNSARCFLQEIGFNDSGKQENLKSICEKIADSNVEGIPASDIVAELVEKTQLPVGSLGIQDPIYMDGCQDFSPTSLEKVINSIEDIISGAGEEEYGQLKSSKLRNKTLEAYSLLNILELEIYKTRLQKLLNQEVYYCQIESIEEMEYEGWVYDFEVSKYHNFVANNIICHNSTYASLNGTSMATPHVAGAAALVKQKNPSWSNVQIRNHLKNTATSLGSTNLYGSGLVNAEAATR

SEQ ID NO: 433 - protein, 743 aa, Artificial Sequence
  Synthetic construct intein-modified proSavinase_S317:Tfu_Pol-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSVTGDTEVTIRRNGRIEFVPIEKLFERVDHRVGEKEYCVLGGVEALTLDNRGRLVWKKVPYVMRHKTDKRIYRVWFTNSWYLDVTEDHSLIGYLNTSKVKPGKPLKERLVEVKPEELGGKVKSLITPNRPIARTIKANPIAVKLWELIGLLVGDGNWGGQSNWAKYYVGLSCGLDKAEIERKVLNPLREASVISNYYDKSKKGDVSILSKWLAGFMVKYFKDENGNKAIPSFMFNLPREYIEAFLRGLFSADGTVSLRRGIPEIRLTSVNRELSDAVRKLLWLVGVSNSLFTETKPNRYLEKESGTHSIHVRIKNKHRFADRIGFLIDRKSTKLSENLGGHTNKKRAYKYDFDLVYPRKIEEITYDGYVYDIEVEGTHRFFANGILVHNSTYASLNGTSMATPHVAGAAALVKQKNPSWSNVQIRNHLKNTATSLGSTNLYGSGLVNAEAATR

SEQ ID NO: 434 - protein, 776 aa, Artificial Sequence
  Synthetic construct intein-modified proSavinase_S317:Tfus_RecA-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLTADTYVWTDRGLETVAEVFGRAGLPLSSTSRVTDVRDRDIRVVNEKGELEQVAALTHNGRQPVVRITVASGRQVTVTRNHPLRVMNDDGFIVWREAGQLREGDVLVSAAFGAVQAASGGGLSEDEAVLLGYLTAAGSLDPAGHVCFTTTDIETGAEFAALAEWLLDTTVTAVPGDGQVAYVLSDPAARHTLAERYGVDYAAAARIPQCVRTAGDKMQRAFLAALYTAAGWTDTSAAVGLRTASAPLAREVQYLLYGLGIPADLDRSHGNGQHPWAVTISPAAAPRFHTEVGFRTAQQSPQTGLHEPTPQVEAIPNLTGLIHALRDSIGDRAESTDDPFPAASGGAYDRDQVRRVIDWAKRRTDEAPATANAILGYLTQLTDARYTYEPITAVEDAGQQPTFDLMVPRTHSFLANGILSHNSTYASLNGTSMATPHVAGAAALVKQKNPSWSNVQIRNHLKNTATSLGSTNLYGSGLVNAEAATR

SEQ ID NO: 435 - protein, 711 aa, Artificial Sequence
  Synthetic construct intein-modified proSavinase_S317:Tfus_RecA-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCMHYDTLVTLADGTQEKIGTIVDRKLDVEVLSYDPETDRIVPRRVVNWFDNGAADHFLQFTVGRSGKPGGAQFTATPNHLIRTPGGWREAGELIAGDRVLVHEPHYLNEQQRQVVYGSLMGRGTLVPDRHGGPGVHFCMAHTAEQAAYLDWKVSLLGNIAHSRTAEASATVGVEFTPMPELSELHRVVDFGDGHTHLTWEFLKQLTPLALAVWYLDAGTLTIPQSGTDDDARVQIDVETLSPGSRQRLVEYLRDTHELDAAVVQQGADARSLLEFTPAATVRFLELVAPYVPESMSSMLLAQFRGRCSVTPEYSDPVQRLVAAPVLDIQVKPGSTRKFDIEVEGNHNYFVDGVMVHNSTYASLNGTSMATPHVAGAAALVKQKNPSWSNVQIRNHLKNTATSLGSTNLYGSGLVNAEAATR

SEQ ID NO: 436 - protein, 891 aa, Artificial Sequence
  Synthetic construct intein-modified proSavinase_S317:Thy_Pol-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSLLPEEWIPLVENGKVRLHRIGEFVDKLMETDSELVKRNGDTEVLEVRGIRALSFDRKSKKARVMPVKAVIRHRYSGDVYEIVLGSGRRITVTEGHSLFAYGDGELREVTGGEIKAGDLLAVPRRVNLPEKKERLNLVELLRRLPEEETGDIILTIPVKGRKNFFKGMLRTLRWISGEEKRPRTARRYLEHLEGLGYVRLKKIGYEVTDREGLERYRKLYERLVEAVRYNGNKREYLVEFNAVRDVIALMPEEELRDWLVGTRNGFRMRPFVEIEEDFAKLLGYYVSEGNARKWRNQKNGWSYTVKLYNENQRVLDDMESLAERFFGRVKRGKNYIEIPRKMAYIIFENLCGTLAENKRVPEAIFTSPESVRWAFIEGYFIGDGDVHPSKRVRLSTKSELLVNGLVLLLNSLGVSAIKIRHDSGVYRVYVNEELPFTDYRKKKNAYYSHVIPKEILEETFGKVFQRSVSYEKFRELVKSEKLDGEKAKRIEWLLNGDVVLDKVLEVKKRPYEGYVYDLSVEEDENFLAGFGLLYAHNSTYASLNGTSMATPHVAGAAALVKQKNPSWSNVQIRNHLKNTATSLGSTNLYGSGLVNAEAATR

SEQ ID NO: 437 - protein, 689 aa, Artificial Sequence
  Synthetic construct intein-modified proSavinase_S317:Tko_CDC21-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSYHHDFELLLADGRKVKIGELVDKLIEKNRDRVILGKDTEILPVEDIELLAYDLEKREIVKVKADRVSRHKAPERFIKLRFSNGREITVTPEHPVMVWENGEITEKPAEKITPGDIALGVLRYPIQVDGKFKERYRDMREAEDYQDYLYSRGVVSKIKRTGIYFTVEKARRALPRELVKPLINAGKILRVTQTPKERASFNQKLVRENIIEGYLQRIIERMDELERLSREDPAKALELLPKTQLYYKYGITYGKLKKLAEARNSWAEGIIQSAVAERISLAKRELEEFFKWWNANVNFLKVKCVEEIKNDRWEWVYDVTVEPHHLFVSHGLVLHNSTYASLNGTSMATPHVAGAAALVKQKNPSWSNVQIRNHLKNTATSLGSTNLYGSGLVNAEAATR

SEQ ID NO: 438 - protein, 757 aa, Artificial Sequence
  Synthetic construct intein-modified proSavinase_S317:Tko_Helicase
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCMHPDTYVVTKSGAKKVSELTEGDEVLTHTGTFKKVIQPLRREHKGRLLVIKAYGTVPVKITPEHMVWVVKQIRHKSHYSDGRQVIWWEFEGPEWMTAQELKERLESETDPKVSYMLLQPIPEPSVDADKIPLRKEVYVVNQHGKTDKLHPSVKRTPEYLPLNFETARLIGLWIAEGSTSKNGVIKFDISSNEEDLTEFITGTIRKYFPHAKIVVKDHERNRRTVRFCNKRFAEWLRENIGHGADNKSIPPLLLLNKNREVRLGLLRGLIEGDGYVRRESQRRANYISYSTVSPSLAYQLQLLVASLGYTSSIHRSIRTEGIGKTRKPIYDVKVSGKSYYSLLEELGFEVPQRGNRTYNVNRTWKNYLLLKVRSIEEEEYEGDVYNLEVEGDESGSVGFIVHNSTYASLNGTSMATPHVAGAAALVKQKNPSWSNVQIRNHLKNTATSLGSTNLYGSGLVNAEAATR

SEQ ID NO: 439 - protein, 900 aa, Artificial Sequence
  Synthetic construct intein-modified proSavinase_S317:Tko_IF2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLLPDEKVILPEHGPITLKGLFDLAKETVVADNEKEIRKLGAKLTIVGEDGRLRVLESPYVWKVRHRGKMLRVKLKNWHSVSVTPEHPFLTTRGWVRADQLKPGDYVAVPRVIHGNESDERFVSFVYEKLKNDELIAKLRGEVLSKISSEFKGDRAYKVERNVFRWEDIERLNLWDEVERVAFTPRMHRSGKPLHYVKLPRSPEEWEAFFYFAGVMFGDGSQDKIANNDVEVYEELKKLSVLGVAVKRVERTTSYEIELTNGKNALLRLLRVLFEYPERQKAKSIRVPRILFIAPRKYVSRFLRGYFDADGHVSLKDARIEVTSASQEFLEDLSLLLLRFGIVSKIYRSDYTTLVISGRRNLDLFRRYIGFSVKNKAEALEKAIKKSRRSESYPIFEELKRLRLLFGFTRTELNSNVPFYGKYESEEAPSYETLMRILDAIEKGSINLDKKIAVLEGRIRDHNYIKAFEKDGLIKDGKLTELGRELLEVWRNREFDSSDVDYIRNLAENLVFIPVEDIEEFEYEGYVYDVTTETHNFVANGILVHNSTYASLNGTSMATPHVAGAAALVKQKNPSWSNVQIRNHLKNTATSLGSTNLYGSGLVNAEAATR

SEQ ID NO: 440 - protein, 879 aa, Artificial Sequence
  Synthetic construct intein-modified proSavinase_S317:Tko_LHR
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGDSKILTGKGPVEIGRLNSNMIAGIWRFQTELVRFEEPHRVEYRREGVKIRTRLGFEIKATKEHKFLTVDENGELRWVEAWKLKEGNWVGVVRRLPSPNVKVSILDLLPPNAYLKLKGEFLRELKLSIQAKFGSIRTYAKKKRWSESYLVKQLNGVYPFRWERLSAVLKDLDLRMTENDVERITSDKGKYSLPIEFTPSMARLLGFWMADGSWKGGTLTLFSSDRKMLEKYKELCKEEFGVVGRIRMLNESTYSLEISFNLLPAIFKNLTGNTERKSKLGTFPSIIYSLPEEHKREFLAGYFDGDGFLEVKGGRVYSAGFSTFNKRFAEGIRDILLQLGIVSSIRAREYDEVQKFKGRVIPKKGASYTVSVLGGEYLKRFFDAVRPWRSDYEGWEGMYNEGYSNSDVVPNLGKRLRSIRERLGISAYRMSKMGFYNPVRVELGEREISRRNLRLLVEFYERVAKEKRVEDVLEELSYLRELAEGDVFFDRITSVEPAYIDVAYGIINSETENYIVEGFISKNSTYASLNGTSMATPHVAGAAALVKQKNPSWSNVQIRNHLKNTATSLGSTNLYGSGLVNAEAATR

SEQ ID NO: 441 - protein, 890 aa, Artificial Sequence
  Synthetic construct intein-modified proSavinase_S317:Tko_Pol-2_Pko_Pol-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLELPERNHVLNLVELLLGTPEEETLDIVMTIPVKGKKNFFKGMLRTLRWIFGEEKRPRTARRYLRHLEDLGYVRLKKIGYEVLDWDSLKNYRRLYEALVENVRYNGNKREYLVEFNSIRDAVGIMPLKELKEWKIGTLNGFRMRKLIEVDESLAKLLGYYVSEGYARKQRNPKNGWSYSVKLYNEDPEVLDDMERLASRFFGKVRRGRNYVEIPKKIGYLLFENMCGVLAENKRIPEFVFTSPKGVRLAFLEGYSSAMATSTEQETQALNEKRALANQLVLLLNSVGVSAVKLGHDSGVYRVYINEELPFVKLDKKKNAYYSHVIPKEVLSEVFGKVFQKNVSPQTFRKMVEDGRLDPEKAQRLSWLIEGDVVLDRVESVDVEDYDGYVYDLSVEDNENFLVGFGLVYAHNSTYASLNGTSMATPHVAGAAALVKQKNPSWSNVQIRNHLKNTATSLGSTNLYGSGLVNAEAATR

SEQ ID NO: 442 - protein, 836 aa, Artificial Sequence
  Synthetic construct intein-modified proSavinase_S317:Tko_RadA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSTYASLNGTSMATPHVAGAAALVKQKNPSWSNVQIRNHLKNTATSLGSTNLYGSGLVNAEAATR

SEQ ID NO: 443 - protein, 843 aa, Artificial Sequence
  Synthetic construct intein-modified proSavinase_S317:Tko_r-Gyr
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTPDTLVSLADGRIMEIKDAVEKSEGNLLSVNGLKPKEAKALKFWEIDWNGPLKVIKLKNGHEIKATPDHGLLVMREGKLGWVSAKNVREGDYVAFAYNTGHRGRDEYTLLKLMIKLGITDVMVELDEEYFNEKVAPIVRERISTSTKYKYLRRRVLPLYLLQEWGLDDYEAHVKSLYRQRAGSKPIPNFKLDGRFWYVFGLVLGDGTLRDSKVLISQTPLKDVKSVLEDVFPFLRVFETTNQVGFSNSIIAEVFRRLGARKGKLHPLVFGLREEYINAMIAGYFDTDGTFSILNDRKGPNFRGILTSKRGDVLRMLSVYLYQIGIMNYLRRDERTGVWDLIISNRSLEKFREKIYPYLRIRRAQFDEAYSVYRASRRAFEGDLLPVAPVFGKLKFKNGTKNRILKETGIDVWNWLKRPEGEIPRDKLSKVLEYAEESPEKEFLKSLVEAGVTWVKVKGVEEELYTGKLYDFTTTTENFLSNGAVSHNSTYASLNGTSMATPHVAGAAALVKQKNPSWSNVQIRNHLKNTATSLGSTNLYGSGLVNAEAATR

SEQ ID NO: 444 - protein, 808 aa, Artificial Sequence
  Synthetic construct intein-modified proSavinase_S317:Tko_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCIDGNAKIIFENDGEEHIMTMAEMYERYKDLGEFYDPEYNRWGINVEEVPVYVKSFDPSTKEITKGKVKVIWKYELGEDVPKYEIKTNKGTRVLTSPWHPFFVITQDLKIVEKRADELREGDMLVGGMPSDDDYEFLLDYWLAGFIAGDGSIDKYRSHVKGHEYVYDRLRIYDYTTETLGIINDHLEKTFGKRYSLQRDRNIHYIDIKAKGITSHYIELLRGITNGIPQPILKEGRNAVLSFITGLFDAEGHVNSKPGVELGMVNRKLIEDITYYLNSLGIKARMRKKPRKDGVDYVMHVEEYSSLLRFYELIGKNLQNSEKRIKLEELLSKHNGGSFGLTLSFEDFKAWSSKYGVEFKTNGSQTLAIIKNEKVSLGQWHRRGRVSKAVLVKMLRKLYDTTKSEDVKRMLHLIEGLEVVKEINVTNEPKTFYDLTVERYQNYLAGENGMVFVHNSTYASLNGTSMATPHVAGAAALVKQKNPSWSNVQIRNHLKNTATSLGSTNLYGSGLVNAEAATR

SEQ ID NO: 445 - protein, 865 aa, Artificial Sequence
  Synthetic construct intein-modified proSavinase_S317:Tko_TopA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLHPDSLIPTPQGVKRIKELPEKGEVFALDFDLKLSRARYRLLERDADEPMYKVTLSDRTELYLTADHPVLVYRDDQLIFVPAEELRENDQVVLFINRSEYSPRTESPTLLGFLLENATSMKDYILYDPEFGGVLRNRIKDAGLKTEILWRFRIREPTYYKYLRGKMPVPIVRFLLEEGVVSIEELREVFRGFSYSTSLTPISFEFSEEFWYLFGLVAGDGHLAKKGAITIPAKDRTEDTVKAVKEIANSLQVPFAFDEKYKMIILRSKSLTRLFELLGCPYGNKTEIFRIPGEIMAKPEWMAAFLAGYYDADGHIGTKPTGGKKSHSPQIVLTSKNRMAIYTVKQMWQLLGVGTYLWEKKDRNGNFMAYELKVYSRDAWRFYEVMKNHLRIKRKDLEHVKEVAIRKRKAYSHHYSVLNVKSWEGKIKSSNVLWKKFDMSNQTAHGRGISLDKLQRIVDYLTDTDLRRIAMGDVYVLGIRSIEKFHYRGKVYDLVVDQYHNFIANGVVVHNSTYASLNGTSMATPHVAGAAALVKQKNPSWSNVQIRNHLKNTATSLGSTNLYGSGLVNAEAATR

SEQ ID NO: 446 - protein, 777 aa, Artificial Sequence
  Synthetic construct intein-modified proSavinase_S317:Tth-HB27_DnaE-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLPARARVVDWCTGRVVRVGEIVRGEAKGVWVVSLDEARLRLVPRPVVAAFPSGKAQVYALRTATGRVLEATANHPVYTPEGWRPLGTLAPGDYVALPRHLSYRPSLHLEGHELDLLGFALAEGHLRHPSGVYLYTSSEEELAAMEEALRAFPNTRIRVVWRRGVAHVYVGRVDRRQEAGAVAFLRRMGLLGLDAKTKRLPEAVFGLPPEEVARFLGRLWTGDGGVDPKGRLIHYATASKELAWGVQHLLLRLGLQSRLVEKRFSGGYKGYAVYLLGGLEAARRFAETVGPYLVGKRRQDLEALLASWEKAGRSTGDVLPLAFLEEVRAAVAEVAQGQVADLLREAGLAEGLLCLGRGRRGLSRATVGRLAALTGSLALLRLAEAEVYWDRVEAVEPLGEEEVFDLTVEGTHTFVAEDVIVHNSTYASLNGTSMATPHVAGAAALVKQKNPSWSNVQIRNHLKNTATSLGSTNLYGSGLVNAEAATR

SEQ ID NO: 447 - protein, 792 aa, Artificial Sequence
  Synthetic construct intein-modified proSavinase_S317:Tth-HB27_RIR1-1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLHPDTLVHTDRGTLRLRELVDPFRRGWQPHTLSVATDEGWRPSPEGYNNGVAPTLRVVLENGLEVQGTLNHKLKVLREDGTREWVELQDLRPGDWVIWVLDEHTGTPVQLAPLDEPLHPNTTPIRTPEVLTEDLAFLLGFFFGEGFVSGDRIGFSVHEEEPMREEAKRLFRELFGLELREERKPGDRSVTLVVRSRPLVTWLRKNGLLKGKARELEVPRAIRQSPRPVLAAFLRGLFEADGTITAGYPMLTTASKRLAQDVMVLLGGLGIPSKLLRYNPLPGRFSKAEHYGVRVVTAKGLERYLERIGVPKGSRLEALHGIKPDVRRESSWPLPHAEGLLKPLLTVTEKGRKGYASPYTPLRKDLLRYLRGERQLTATGYAMVLEKAQDLGLEAEPFPFNEYYVRVASVEPGGEILTLDLSVEGNHTYLANGLVSHNSTYASLNGTSMATPHVAGAAALVKQKNPSWSNVQIRNHLKNTATSLGSTNLYGSGLVNAEAATR

SEQ ID NO: 448 - protein, 761 aa, Artificial Sequence
  Synthetic construct intein-modified proSavinase_S317:Tth-HB27_RIR1-2
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFVGSTRIPTERGLVPIEELAREGGSFYLVTDNRAPFGGRGAPLPGHGTAVRKAVRAFFTGVKPVVRLRTREGLEVTLTPDHLLLTPEGYREAGKLRPGEKILVQSGEGLFPKEESLPAQALAVVHERVATAGGRGGRGRADVRAQYRNLPTRWSRELGVALGWLLGDGYLREDGVGFYFSRKDFADLAWLPDLLRDWFGPGTLQETRSNTFHLHFNRIPAEFFQALGVKAARATEKRVPESLFRAPREAVVGFLQGLFSADGSVQINENKQDATVRLASSSLALLQDVQLLLLNLGILGKIHKRREAARKALPDGKGGLREYPVAPQYELILGGENRDRFAEVVGFLQEEKQSKLLAFLRHRPRGSYRKPFLATVASVEPAGEAPVYDLTEPVTHSLIANGLVAHNSTYASLNGTSMATPHVAGAAALVKQKNPSWSNVQIRNHLKNTATSLGSTNLYGSGLVNAEAATR

SEQ ID NO: 449 - protein, 540 aa, Artificial Sequence
  Synthetic construct intein-modified proSavinase_S317:Tvo_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVSGETPVYLADGKTIKIKDLYSSERKKEDNIVEAGSGEEIIHLKDPIQIYSYVDGTIVRSRSRLLYKGKSSYLVRIETIGGRSVSVTPVHKLFVLTEKGIEEVMASNLKVGDMIAAVAESESEARDCGMSEECVMEAEVYTSLEATFDRVKSIAYEKGDFDVYDLSVPEYGRNFIGGEGLLVLHNSTYASLNGTSMATPHVAGAAALVKQKNPSWSNVQIRNHLKNTATSLGSTNLYGSGLVNAEAATR

SEQ ID NO: 450 - protein, 506 aa, Artificial Sequence
  Synthetic construct intein-modified proSavinase_S317:Tvu_DnaE-n_NC-terminal
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLSGETAVMTVEYGAIPIRRLVQERLICQVYSLDPQGHLYTQPIAQWHFQGFRPVYAYQLEDGSTICATPDHRFMTTSGQMLPIEQIFREGLELWQVAIAPPGALAQGLKPAVQMSCMKIVGRRLVGWQAVYDIGLAGDHNFLLANGAIAANSTYASLNGTSMATPHVAGAAALVKQKNPSWSNVQIRNHLKNTATSLGSTNLYGSGLVNAEAATR

SEQ ID NO: 451 - protein, 661 aa, Artificial Sequence
  Synthetic construct intein-modified proSavinase_S317:Unc-ERS_RIR1
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLFDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHNSTYASLNGTSMATPHVAGAAALVKQKNPSWSNVQIRNHLKNTATSLGSTNLYGSGLVNAEAATR

SEQ ID NO: 452 - protein, 810 aa, Artificial Sequence
  Synthetic construct intein-modified proSavinase_S317:Zba_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAKGTEVMMHDGSVKAIETIEAGEAVMGTDGQPRKVVGLPRGREVMYKVSQKTAHRVHKTDETRAAPVALFEYNCNATHKLVVRTPRSCRSITRKMQGVDYNEVIFFDLKKKKLEDGREIEIVKEVSRSYPAAEGAEKAAQMVKDYYDAARGKEFFEWTIEARDVRELGAHVRKATHQVYAPVLYESDFFFHYVKNSKFALRSEASTALAYLLGLWVGDGLSDRAVLSVDSEDSSLLERITGYADILDLSAEYKDREIPKRAKTVCLYPKTIRGNDIRRNLNTDNPVWNAIVDLGYLKDGVKNVPSYLFSDSICHREVFLAGLIDSDGHVRGDDGLSVTIKTIHKTVMEGTVAVARSLGLIVSVNTEEAKIDKNDVNHRFVYAIYISGGDALLSVLAHCAAAKKFRAPPSNEVVRGLKKVFFEMEELKEDDYYGITLAKESDHQFLLANQLVVHNSTYASLNGTSMATPHVAGAAALVKQKNPSWSNVQIRNHLKNTATSLGSTNLYGSGLVNAEAATR

SEQ ID NO: 453 - protein, 804 aa, Artificial Sequence
  Synthetic construct intein-modified proSavinase_S317:Zro_VMA
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAKGTEVMMSDGSIKEVEGIEVGQEVMGKDGKPREVVGTPSGREKMYKVSHKTAHRAHKSDSTSERFGLFEYTCNATHKLVVRTSRSCRPLVRNIQGTDYVEVCLFNMTKKTLEDGRVIDIVEETSDFYPAVEGPEKALRILKEYAEADGGKEYFEWTIEARDVALLSAQVRKATYQLSAPVLLENNHFSHYLKDSNSAVGNDTVRALSYFLGLWIGDGMLNNAATFSVDSQNASLLNRINEFAEVLGLSAEYKDSQEPKRAKTVNLYAKAIRDEGVRKNLDTHNLLWDAIVDLGYLKDDSKNVPGYICSDSFQHREVFLAGIIDSTGYVSDETATVKTIDQSVMTGTVAVARSLGINVSVDVEVDEDGVDRSFVYAIYMDRSDALLAVLANCASNNKQIEAPPHGVIREFNKAYFEMEELEEDEYYGLTLSNESDHQFLLANQLVVHNSTYASLNGTSMATPHVAGAAALVKQKNPSWSNVQIRNHLKNTATSLGSTNLYGSGLVNAEAATR

SEQ ID NO: 454 - protein, 386 aa, Artificial Sequence
  Synthetic construct NI-GG-6H
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLDLKTQVQTPQGMKEISNIQVGDLVLSNTGYNEVLNVFPKSKKKSYKITLEDGKEIICSEEHLFPTQTGEMNISGGLKEGMCLYVKEGGHHHHHH

SEQ ID NO: 455 - protein, 208 aa, Artificial Sequence
  Synthetic construct IC-SUMO-6H
MMLKKILKIEELDERELIDIEVSGNHLFYANDILTHNSTYASLNGTSMATPHVAGAAALVKQKNPSWSNVQIRNHLKNTATSLGSTNLYGSGLVNAEAATRMGSLQDSEVNQEAKPEVKPEVKPETHINLKVSDGSSEIFFKIKKTTPLRRLMEAFAKRQGKEMDSLTFLYDGIEIQADQTPEDLDMEDNDIIEAHREQIGGHHHHHH

SEQ ID NO: 456 - protein, 209 aa, Artificial Sequence
  Synthetic construct S135_IMPDH-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFVPGTLVNTENGLKKIEEIKVGDKVFSHTGKLQEVVDTLIFDRDEEIISINGIDCTKNHEFYVIDKENANRVNEDNIHLFARWVHAEELDMKKHLLIELE

SEQ ID NO: 457 - protein, 343 aa, Artificial Sequence
  Synthetic construct S269_IMPDH-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCFVPGTLVNTENGLKKIEEIKVGDKVFSHTGKLQEVVDTLIFDRDEEIISINGIDCTKNHEFYVIDKENANRVNEDNIHLFARWVHAEELDMKKHLLIELE

SEQ ID NO: 458 - protein, 367 aa, Artificial Sequence
  Synthetic construct S293_IMPDH-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACFVPGTLVNTENGLKKIEEIKVGDKVFSHTGKLQEVVDTLIFDRDEEIISINGIDCTKNHEFYVIDKENANRVNEDNIHLFARWVHAEELDMKKHLLIELE

SEQ ID NO: 459 - protein, 391 aa, Artificial Sequence
  Synthetic construct S317_IMPDH-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFVPGTLVNTENGLKKIEEIKVGDKVFSHTGKLQEVVDTLIFDRDEEIISINGIDCTKNHEFYVIDKENANRVNEDNIHLFARWVHAEELDMKKHLLIELE

SEQ ID NO: 460 - protein, 392 aa, Artificial Sequence
  Synthetic construct T318_IMPDH-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSCFVPGTLVNTENGLKKIEEIKVGDKVFSHTGKLQEVVDTLIFDRDEEIISINGIDCTKNHEFYVIDKENANRVNEDNIHLFARWVHAEELDMKKHLLIELE

SEQ ID NO: 461 - protein, 196 aa, Artificial Sequence
  Synthetic construct S135_gp41-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLDLKTQVQTPQGMKEISNIQVGDLVLSNTGYNEVLNVFPKSKKKSYKITLEDGKEIICSEEHLFPTQTGEMNISGGLKEGMCLYVKE

SEQ ID NO: 462 - protein, 330 aa, Artificial Sequence
  Synthetic construct S269_gp41-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLDLKTQVQTPQGMKEISNIQVGDLVLSNTGYNEVLNVFPKSKKKSYKITLEDGKEIICSEEHLFPTQTGEMNISGGLKEGMCLYVKE

SEQ ID NO: 463 - protein, 354 aa, Artificial Sequence
  Synthetic construct S293_gp41-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACLDLKTQVQTPQGMKEISNIQVGDLVLSNTGYNEVLNVFPKSKKKSYKITLEDGKEIICSEEHLFPTQTGEMNISGGLKEGMCLYVKE

SEQ ID NO: 464 - protein, 378 aa, Artificial Sequence
  Synthetic construct S317_gp41-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLDLKTQVQTPQGMKEISNIQVGDLVLSNTGYNEVLNVFPKSKKKSYKITLEDGKEIICSEEHLFPTQTGEMNISGGLKEGMCLYVKE

SEQ ID NO: 465 - protein, 379 aa, Artificial Sequence
  Synthetic construct T318_gp41-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSCLDLKTQVQTPQGMKEISNIQVGDLVLSNTGYNEVLNVFPKSKKKSYKITLEDGKEIICSEEHLFPTQTGEMNISGGLKEGMCLYVKE

SEQ ID NO: 466 - protein, 199 aa, Artificial Sequence
  Synthetic construct S135_gp41-8-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLSLDTMVVTNGKAIEIRDVKVGDWLESELGPVQVTEVLPIIKQPVFEIVLKSKSGKKIRVSANHKFPTKDGLKTINSGLKVGDFLRSRAK

SEQ ID NO: 467 - protein, 333 aa, Artificial Sequence
  Synthetic construct S269_gp41-8-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLSLDTMVVTNGKAIEIRDVKVGDWLESELGPVQVTEVLPIIKQPVFEIVLKSKSGKKIRVSANHKFPTKDGLKTINSGLKVGDFLRSRAK

SEQ ID NO: 468 - protein, 357 aa, Artificial Sequence
  Synthetic construct S293_gp41-8-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACLSLDTMVVTNGKAIEIRDVKVGDWLESELGPVQVTEVLPIIKQPVFEIVLKSKSGKKIRVSANHKFPTKDGLKTINSGLKVGDFLRSRAK

SEQ ID NO: 469 - protein, 381 aa, Artificial Sequence
  Synthetic construct S317_gp41-8-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLSLDTMVVTNGKAIEIRDVKVGDWLESELGPVQVTEVLPIIKQPVFEIVLKSKSGKKIRVSANHKFPTKDGLKTINSGLKVGDFLRSRAK

SEQ ID NO: 470 - protein, 382 aa, Artificial Sequence
  Synthetic construct T318_gp41-8-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSCLSLDTMVVTNGKAIEIRDVKVGDWLESELGPVQVTEVLPIIKQPVFEIVLKSKSGKKIRVSANHKFPTKDGLKTINSGLKVGDFLRSRAK

SEQ ID NO: 471 - protein, 213 aa, Artificial Sequence
  Synthetic construct S135_NrdJ-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLVGSSEIITRNYGKTTIKEVVEIFDNDKNIQVLAFNTHTDNIEWAPIKAAQLTRPNAELVELEIDTLHGVKTIRCTPDHPVYTKNRGYVRADELTDDDELVVAI

SEQ ID NO: 472 - protein, 347 aa, Artificial Sequence
  Synthetic construct S269_NrdJ-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLVGSSEIITRNYGKTTIKEVVEIFDNDKNIQVLAFNTHTDNIEWAPIKAAQLTRPNAELVELEIDTLHGVKTIRCTPDHPVYTKNRGYVRADELTDDDELVVAI

SEQ ID NO: 473 - protein, 371 aa, Artificial Sequence
  Synthetic construct S293_NrdJ-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACLVGSSEIITRNYGKTTIKEVVEIFDNDKNIQVLAFNTHTDNIEWAPIKAAQLTRPNAELVELEIDTLHGVKTIRCTPDHPVYTKNRGYVRADELTDDDELVVAI

SEQ ID NO: 474 - protein, 395 aa, Artificial Sequence
  Synthetic construct S317_NrdJ-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLVGSSEIITRNYGKTTIKEVVEIFDNDKNIQVLAFNTHTDNIEWAPIKAAQLTRPNAELVELEIDTLHGVKTIRCTPDHPVYTKNRGYVRADELTDDDELVVAI

SEQ ID NO: 475 - protein, 396 aa, Artificial Sequence
  Synthetic construct T318_NrdJ-1-NI
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSCLVGSSEIITRNYGKTTIKEVVEIFDNDKNIQVLAFNTHTDNIEWAPIKAAQLTRPNAELVELEIDTLHGVKTIRCTPDHPVYTKNRGYVRADELTDDDELVVAI

SEQ ID NO: 476 - protein, 286 aa, Artificial Sequence
  Synthetic construct S135_IMPDH-IC
MKFKLKEITSIETKHYKGKVHDLTVNQDHSYNVRGTVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 477 - protein, 152 aa, Artificial Sequence
  Synthetic construct S269_IMPDH-IC
MKFKLKEITSIETKHYKGKVHDLTVNQDHSYNVRGTVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 478 - protein, 128 aa, Artificial Sequence
  Synthetic construct S293_IMPDH-IC
MKFKLKEITSIETKHYKGKVHDLTVNQDHSYNVRGTVVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 479 - protein, 104 aa, Artificial Sequence
  Synthetic construct S317_IMPDH-IC
MKFKLKEITSIETKHYKGKVHDLTVNQDHSYNVRGTVVHNSTYASLNGTSMATPHVAGAAALVKQKNPSWSNVQIRNHLKNTATSLGSTNLYGSGLVNAEAATR

SEQ ID NO: 480 - protein, 103 aa, Artificial Sequence
  Synthetic construct T318_IMPDH-IC
MKFKLKEITSIETKHYKGKVHDLTVNQDHSYNVRGTVVHNTYASLNGTSMATPHVAGAAALVKQKNPSWSNVQIRNHLKNTATSLGSTNLYGSGLVNAEAATR

SEQ ID NO: 481 - protein, 283 aa, Artificial Sequence
  Synthetic construct S135_gp41-1-IC
MMLKKILKIEELDERELIDIEVSGNHLFYANDILTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 482 - protein, 149 aa, Artificial Sequence
  Synthetic construct S269_gp41-1-IC
MMLKKILKIEELDERELIDIEVSGNHLFYANDILTHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 483 - protein, 125 aa, Artificial Sequence
  Synthetic construct S293_gp41-1-IC
MMLKKILKIEELDERELIDIEVSGNHLFYANDILTHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 484 - protein, 101 aa, Artificial Sequence
  Synthetic construct S317_gp41-1-IC
MMLKKILKIEELDERELIDIEVSGNHLFYANDILTHNSTYASLNGTSMATPHVAGAAALVKQKNPSWSNVQIRNHLKNTATSLGSTNLYGSGLVNAEAATR

SEQ ID NO: 485 - protein, 100 aa, Artificial Sequence
  Synthetic construct T318_gp41-1-IC
MMLKKILKIEELDERELIDIEVSGNHLFYANDILTHNTYASLNGTSMATPHVAGAAALVKQKNPSWSNVQIRNHLKNTATSLGSTNLYGSGLVNAEAATR

SEQ ID NO: 486 - protein, 291 aa, Artificial Sequence
  Synthetic construct S135_gp41-8-IC
MCEIFENEIDWDEIASIEYVGVEETIDINVTNDRLFFANGILTHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 487 - protein, 157 aa, Artificial Sequence
  Synthetic construct S269_gp41-8-IC
MCEIFENEIDWDEIASIEYVGVEETIDINVTNDRLFFANGILTHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 488 - protein, 133 aa, Artificial Sequence
  Synthetic construct S293_gp41-8-IC
MCEIFENEIDWDEIASIEYVGVEETIDINVTNDRLFFANGILTHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 489 - protein, 109 aa, Artificial Sequence
  Synthetic construct S317_gp41-8-IC
MCEIFENEIDWDEIASIEYVGVEETIDINVTNDRLFFANGILTHNSTYASLNGTSMATPHVAGAAALVKQKNPSWSNVQIRNHLKNTATSLGSTNLYGSGLVNAEAATR

SEQ ID NO: 490 - protein, 108 aa, Artificial Sequence
  Synthetic construct T318_gp41-8-IC
MCEIFENEIDWDEIASIEYVGVEETIDINVTNDRLFFANGILTHNTYASLNGTSMATPHVAGAAALVKQKNPSWSNVQIRNHLKNTATSLGSTNLYGSGLVNAEAATR

SEQ ID NO: 491 - protein, 286 aa, Artificial Sequence
  Synthetic construct S135_NrdJ-1-IC
MEAKTYIGKLKSRKIVSNEDTYDIQTSTHNFFANDILVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 492 - protein, 152 aa, Artificial Sequence
  Synthetic construct S269_NrdJ-1-IC
MEAKTYIGKLKSRKIVSNEDTYDIQTSTHNFFANDILVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 493 - protein, 128 aa, Artificial Sequence
  Synthetic construct S293_NrdJ-1-IC
MEAKTYIGKLKSRKIVSNEDTYDIQTSTHNFFANDILVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 494 - protein, 104 aa, Artificial Sequence
  Synthetic construct S317_NrdJ-1-IC
MEAKTYIGKLKSRKIVSNEDTYDIQTSTHNFFANDILVHNSTYASLNGTSMATPHVAGAAALVKQKNPSWSNVQIRNHLKNTATSLGSTNLYGSGLVNAEAATR

SEQ ID NO: 495 - protein, 103 aa, Artificial Sequence
  Synthetic construct T318_NrdJ-1-IC
MEAKTYIGKLKSRKIVSNEDTYDIQTSTHNFFANDILVHNTYASLNGTSMATPHVAGAAALVKQKNPSWSNVQIRNHLKNTATSLGSTNLYGSGLVNAEAATR

SEQ ID NO: 496 - protein, 687 aa, Artificial Sequence
  Synthetic construct intein-modified proSavinase_S317:Unc-ERS_RIR1_var7
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLSDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHNSTYASLNGTSMATPHVAGAAALVKQKNPSWSNVQIRNHLKNTATSLGSTNLYGSGLVNAEAATR

SEQ ID NO: 497 - protein, 135 aa, Clostridium thermocellum
  MISC_FEATURE (1)..(135): Cth_ATPase_BIL
CFVAGTMILTVAGLVAIENIKAGDKVIATNPETFEVAEKTVLETYVRETTELLHLTINGDVIKTTFEHLFYAKDVGFVEAKELQVGDKLLDSKGNVLVVEDKKIKITDEPVKVYNFQVDDFHTYHVGCNGVLVHN

SEQ ID NO: 498 - protein, 347 aa, Crocosphaera watsonii WH 8501
  MISC_FEATURE (1)..(347): Cwa_RIR1
CVAPETKILTDRGQIAIADVAGEKVNIWNGSEWSEVLVKKTGENQPLLKVHFSNGESLDCTYYHKFHVQENYKGKVKIVEAKDLQEGDKLIKYRLPLVESENDIDFPYAYTSGFFSGDGSHDGMGKPEIDLYGEKKELLPFVTVRNKYYGGSYGDKSWRIERDEVAVYDDVNQDRIVCKLPLDIPAKFTVPVNGYTIQSRLEWLAGLLDADGTVARNGDNESLQVASTHQQFLLDIRLMLQTLGVDSKVVKMDEMGYRSLPDGKGGYQDYFCQAKYRLLISSNGLFQLGELGLKTNRLQWNLREPQREASQFIRVEKVELTCRYDDTYCFSEPKRHLGMFNGILTGQ

SEQ ID NO: 499 - protein, 607 aa, Debaryomyces hansenii
  MISC_FEATURE (1)..(607): Dhan_GLT1
CLASDTLVRTSEGDKPVAEVAIGDYLLDAEDKPVLCMGANPSQTGRMKEIAYQDFDSKKRVSFKCTPDHHLELTLTDSTPSLSGKSVTWFSRCTGAHLSEEVSEVYLDNMVSIFYNDLVDSTDSAVDKDSIHEAVDLALEDHYHRGNSDQYSIHLNEYISRIADKELQNEPEFIRECIHDAANRFVITSSGNRNIKSESFDDKLLLSRSRSSTADSDSDYVITDASVHSHSNNSSVYLASPDSMIPDGAANRFENIASKLKEPVCNCGGIRKIFRSFGTTEDAELAYSLLLSEHYYRLDPRFVTDGYTFQASVEQYENMCSQEVQNMHLKLYRSPLKFVEREHNSAELPVDPYFLGLWLGDGDSSGTTIMTTDREIVVWLNSYVERLNQNKPEGCFPLKLTEQLIYGAGHTSKSGHTTKVDVRNYKISSGDAFVRSGTYWNPIFDGLKKLGLLNNKSAGIPQEYMNSDEQNRLSVIAGLMDSDGCYVKSHNTYRFTQLTEDHKKIVYDLKELALSCGINTTGVELSVKPLGFNKHKHSTEYVVYLGNGSQKFQELLLLPRKKMEISKKHVSLDARPFTVSDVEDGEFRAIEVSGGVFQLANRLVVAN

SEQ ID NO: 500 - protein, 294 aa, Frankia sp. HFPCCI3
  MISC_FEATURE (1)..(294): Fsp-CcI3_RIR1
CQPYDALVSTPSGLVPIGALVETDAVGMKVFDAHGLTQVIATKSNGVKDVLRIWTRAGHALDVTADHLVWRSTSAGAGAFVPAGALRAGDTLEWHRTIAPGEGEITSREIAEAALAGRLQADGFVGRYAGTNASLTIEAMTVPTRLYDAPLPVVAAYLRSLFQADGYVSRRERSTLIGLDMISEGLIRGVQGLLARFGIFARVRREADPRPDRHDLWSLGIQNAGDRRTFADEIGFLDPVKAAKLEASFDQPGQAAKPVKRLQIERIEPRGPMPVYDIQTDSGEYLSAGLRVHN

SEQ ID NO: 501 - protein, 287 aa, Gemmata obscuriglobus
  MISC_FEATURE (1)..(287): Gob_Hyp
CQPAGTQVAKVIKEGRWREDSVIEQVPIESLQPGDRVVSFGNAKIYRRGRAVTGITSRRHTGNLHRVEVGEFRTRATPEHRFTVRFDPARPKAGLLYLMRRGDRWRVGVCGMFNSRGFGVSVRLSQERGDAAWVLGAFATLTEARIAEQVVSCRYGIPTTVWETGRNPGASWAQRDQAGIDAIYQRLGVDRIRAGVDRLLRDHGLSAGLPLLAANEPGNFSCRQSRQVAACNLVPGVMQVPVPTAGERFEWRDLTATSFERVHDLEVWSMDVERDKHYVADGIVVHN

SEQ ID NO: 502 - protein, 412 aa, Gloeobacter violaceus
  MISC_FEATURE (1)..(412): Gvi_RIR1-1
CFAAGTLLHTEQGYVPVEQVVAGVGTRVCTHQGFRNISERFDNGEAEVFRVTTRKGYSVEVTANHKMARLDENGDLLLDELSHLQVGDNLLLLLGSNPVTEKVRLQCIPAGYRSSIEIAQPPELDEQLAYLLGYAYGDGCVGRGATYNYLSLAVSHTYPNVRDQLAAIIREKFGLTTKIYSGSGAVWNLLVHSANLLDWLKANGLLKQKAADLAMPEAILRSPSSVVGAFLSGYFDADGCVRGGKGGYGFDCTSKAFVGAVQLLLLAEGIVSNLHTTDRSRQGWRTIYRLNVCGTEFKRRFQTLCCRSAKVVHSPMVLGRDGTGGYPPALVRGASYQRVVAVGGKHLLYTALLKVIEKTRTAGKQALAESLCQHVNYFPDPIVAIESVGTQRVYDIEVEGMHLLGNGIYTSN

SEQ ID NO: 503 - protein, 492 aa, Ectothiorhodospira halophila
  MISC_FEATURE (1)..(492): Hhal_DnaB-1
CLAYDAEIVQADGGVKTIEQIVRERRAHLATVGADWRLTWTEPCDYVDDGHKPVFEVTTRLGRRIETTLTHPFLTVHGWQRLEDLAEGDAIGVPRQLPVFGQEPIRDCEVRLLGHLIGDGGLTGSPPRLTSGQEAMTADFLEAVDAFGGVEAKPIRASRRTQSWVVVGAAQARAAARSSFASLVDALIRRSPLTGRAIARNLGVAPATLTYWRQGVNVPDAAMVGLLAGELGVDVGELRPEPVARRNDRNPLQAWLDRLGLAGKSAHEKTVPDCVFRLPREQLARFLNRLFSSDGWVTHLASGQGQIGYTTVSEALARQIQHLLLRFGVLAKLRHRSVRYQDGRRPAWQLDITHAESILTFAEQIGILGKEQRLASVAASVRGRRRQSHTDHIPCEIWQFIDRARGEWTWAELARRAGVASSNIHAYRRGMSRQRLAAFADALGSRELRQLASSDLYWDRIASIRPLGHKQVYDLTIPETHNFIANDVCVHN

SEQ ID NO: 504 - protein, 477 aa, Haloarcula marismortui
  MISC_FEATURE (1)..(477): Hma_CDC21
CVHGDTRVTLADGHERPIREVVESNLDDPKPVDDGVWDTVDFDVPSLQSDGTVATQNATKVWKRKAPETLYRIRTATGRELDVTPSHPLFVQSDGRFQARKAEELESGTHVAVPRKVSTNACNELDVTFRQSQAHNRIDLDLPPQWTPELARLIGYIVAEGYVEQRPDNTGYVSITNNDREVLDDAKSVLETLNLNVTERSSHEGKTARELLCSAGEFVSFLASLDETLLQSSAERRVPQDIMRASDNVVTGFIRGYIEGEGHVSTSQREITVASMSKPLLEDVRTLLVTQGITAQLQPRNNGSYRLRISGQSFHDYAEQIGFITARKTEACRQFEGTHGNTNLDIVPNLGPELRRIREALGLTQSECGLPRSTYQHYERGRRNPSRDSLESVLDAFETRLAEMNNDTPISDTARSDGGGTGSLRQDLNGLAALVEGDIAWDRIESIEPIEHDEKWVYDLEIEGTHNYLTNGVVSHN

SEQ ID NO: 505 - protein, 209 aa, Haloquadratum walsbyi DSM 16790
  MISC_FEATURE (1)..(209): Hwa_MCM-1
CVSGETDIALVEGKTATIGELVESALTDPKPVDDGVWDTADFTVTSAIETGELIERDVTRVWKRQSPETMRQIQIAGGRSVTVTPSHPVFVEHNGSYTARRADSLSAGESVAIADDVADSHPISVDNTANTLNPRSMSTPGITTDGGLYRTGSDGGIVHAEVGKEDVTDCLTTDRITAVKTVTPTAEWVYDLEVEGTHAYLTNGVLSHN

SEQ ID NO: 506 - protein, 358 aa, Haloquadratum walsbyi DSM 16790
  MISC_FEATURE (1)..(358): Hwa_PolB-2
CFTPDTNVLTPNGVRNIRDLTVGDSVYSLNPETMQMEIKPVTQTHEYPDYQGDLIDIQTNEIDFRVTPNHRMLVEATGTDTTSTNDYDFIEAGNLDISSRYELPHGWSVDHTDSLGAYIDLITLLREQSDTYNVLSDGGMTTAATADINHNNVTRRVDSDTFVSLIGWYVATGRVSRTQNGSDRVYLQLSQTNTKARTQLTMLLDELGVDWQADNEKIHFVSHVWTELFDTTCGRTEKNKHIPELIFDASASQKRAFFDAIINGSGVKNDDSYQYHTSSEDLRDDILRLCVHIGIVARYDYINDESWRIECTETANPDFTLTHSGRQSTAEDGVYCVTVADNQTLLAGRNGTFQWTGN

SEQ ID NO: 507 - protein, 408 aa, Haloquadratum walsbyi DSM 16790
  MISC_FEATURE (1)..(408): Hwa_RIR1-1
CLTADSTVMLKEKGMVSVSEVETGDQIAQRSDTGFQYKPVEETHAYENAETLTVTLTNGCSIRGTPNHRLMVDDEWTRIDEIQPDQEVHYTLGWLRETNQSPPKLHSQSHTTVNQTADSISPDSSEPIELSESENADTGNRHNSAVAVKQSRTQTQLISDEVVSRPEHTRRPDQLSEELAELLGLWIDTGLWHQSGVQFNVERENIAEYIDQLSQQLFDTPAAISDTDGTYTVDITDHKLKEWWKANFGGKPDGTQSSYVPQMIKEAPTNVIEAFLRGCFTAEGGLRKDMRPRLCTSSEDSIDDIAVLMMGLGYPVEKSVIRNADGEPYYSVMPATDDGLSAFLHDVGFIDERREIGLSNIESSDSRALNNTHKIEVESIVESPPATVYDITVADNHEYVTDGIISHN

SEQ ID NO: 508 - protein, 438 aa, Haloquadratum walsbyi DSM 16790
  MISC_FEATURE (1)..(438): Hwa_RIR1-2
CVEENSLVSTDEGLRPIKDLDNTTAEFEQWDEIDVGVTTDGGTKTATAVYDNGFANVRQIQTESGFNIAATPNHRFRTLSSDGTYTWKEAGKFESGDRVILQRNTFDAGSRVSLEANERADDAQDTTEGPELPGRMTSELAEFLGYFMGSGYISDETHASVDLVVDSDATELNSYLSNLGEQLFRITPAVESQEMSQVLSFRDCHLSRYFEDNGWKKTDTGHNGDASAAFVPEQILEGDEQVVNGFLRGVFEAIGTVSEKIEILTTSTTLADQLQSLLLSLGHVFTRDSTKLVETNNYHDDQLRQRLCGATRREDERFMNEIGSLIEPDELNLSTRADKNDTYPSSVIDHVQTLDGYDSVSESLKSRINQSQVDGTVSRKLIKDIEAETAETVSIADHELTGFYAATVESVTEDTAYTKDISVPSNNTYIADGFVTHN

SEQ ID NO: 509 - protein, 214 aa, Haloquadratum walsbyi DSM 16790
  MISC_FEATURE (1)..(214): Hwa_rPol_App
SIEADESIVIRRDGETELTEIGSFVDTILAADNQETRITDGHEIALAPNGLEVPSLDTDEQIRWKHIEAVSRHASPDEILLIELESGRSIRATKAHSFVTRRDGDVLPVAGETLVVGDVLPTVGSYDHASGSISVPLQSQSVAADGGTVEPNTNITANAERDSASITSAGIIGSATWERISSIETVAPEYEYVYDLSVSGLETFTTGEGVVTHN

SEQ ID NO: 510 - protein, 428 aa, Kineococcus radiotolerans SRS30216
  MISC_FEATURE (1)..(428): Kra_DnaB
CLTAGTRVLRADTGAETTMGELFALQARDVPVWSLDESLRYVRRHLTRVFPTGVKPVFRLRTASGKTVRATANHPFLTYDGWKPLGELSVADRLAVPRHVPAPERVASWTDDQVLLLGHLIGDGSFVKRQPLRYASVDEANLSAVTEAAANAFSIVAVRDEYAAARCTTLRLPAPYRLTHGRRNPLAAWLDELGLFGLRSYEKFVPQEVFHLPKRQIALFLRHLWATDGSVTLTRQSRGGRIYYASTSLQLIQDVSRLLLRFGISTRVRTTTPKGDHRPGYTLDVSGVDDQRRFLQEIGVHGARGATADRLLEVIRDVSANTNVDTVPRQVWDDVRRLLVEKEMTHREFAAAMGTSFGGSSLWKHAPSRERLGRVAQVLDSAELDVLAVNDVLWDEVVAIEPDGEEQVYDATVLGGHNFVADGIAVHN

SEQ ID NO: 511 - protein, 380 aa, Methylococcus capsulatus
  MISC_FEATURE (1)..(380): Mca_RIR1
CVTADTWVMTASGARQVRDLIDRPFEAVVDGECHPTESRGFFFTGDKPVLRLSTAEGHTLRLTANHPVLRVSKMTRQLRETEWVKAGELRPHDKIVLHDHRALPSWDGAHTEAEGYLIGLLIGGGTLTRDKAILSIWDAAAPKVANGGGSVPAAGVAGVMRAAELAARTLPHRTDFNGWQTTMEGRGEYHMATGALHTLALELGLTPGDKRLTAPLETTSSAFHRGLLRGMFDADGSVQGSQRKGVSIRLPQTDLGNLQTVQRMLLRLGVASTIHQNRRPGGTKVLPDGEGGAKGHSCQAAHELIISGENVVRYAERIGFADSDKMDRLTALLQRYRHTRHAERFIATVQSLEDDGMEAVYDVTVADVHAFDANGLYVHN

SEQ ID NO: 512 - protein, 165 aa, Methanoculleus marisnigri
  MISC_FEATURE (1)..(165): Memar_Pol-II
CFAGDTEITVSDGRRWMSLPIRQFVTENFDISKPGLDHVGTFYSDPRQPFYVRSIDSQGKTSLKRVTSVSVHRAPAHLVRFATRRGRVLTVTPDHAMLVWDTDYLRKIKALEVAVGDRVPVEEGGLVVADEVVSRETVQALDDRVYCLTVAENHTLVANGIFCGQ

SEQ ID NO: 513 - protein, 270 aa, Methylobacterium extorquens
  MISC_FEATURE (1)..(270): Mex_helicase
CFAAGTLIKTPKGPVPIEQIQSGDLVFNAIGIGVVEGIVCQQKQTITLELSDGTSIVCTHDHPFFCPRGWVAAGDLEVGSGLFSHEDLRRLWSGGASLGLESGSSDGRGAVRSSEVLLRILREEAREPDAGYCGPAEDVRNASTDRAHAEGAWWQWQADPIASDEAARSAGRRVADRVRDEDRREARPEPTAVLLQDRHCEPLANDRNRSGREHSSRGTGEAEGQRQGDVPCSVRVVSISREERGGPEAVYNLRVSGHPSYFAGGVLVHN

SEQ ID NO: 514 - protein, 165 aa, Methanospirillum hungatei
  MISC_FEATURE (1)..(165): Mhu_Pol-II
CFHGDTLIEIYADGILEEIPIRRFVLEHLDLSQAGVDALGTFYADPVRPAHVRSVDTGGIPHLRKITSVSVHKAPANLIQFSTSRGKNLLVTPDHAMLVWDVSYLRKIRALEVKIGDAVPVWESGVVISDRIVSIDYVPCEDERVYCLTVDRDHNVVGNGIFTGQ

SEQ ID NO: 515 - protein, 168 aa, Methanococcus jannaschii
  MISC_FEATURE (1)..(168): Mja_Klba
ALAYDEPIYLSDGNIINIGEFVDKFFKKYKNSIKKEDNGFGWIDIGNENIYIKSFNKLSLIIEDKRILRVWRKKYSGKLIKITTKNRREITLTHDHPVYISKTGEVLEINAEMVKVGDYIYIPKNNTINLDEVIKVETVDYNGHIYDLTVEDNHTYIAGKNEGFAVSN

SEQ ID NO: 516 - protein, 412 aa, Methanococcus jannaschii
  MISC_FEATURE (1)..(412): Mja_PEP
CIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFN

SEQ ID NO: 517 - protein, 476 aa, Methanococcus jannaschii
  MISC_FEATURE (1)..(476): Mja_Pol-2
SILPDEYLTIIEEDGIKVVKIGEYIDDLMRKHKDKIKFSGISEILETKNLKTFSFDKITKKCEIKKVKALIRHPYFGKAYKIKLRSGRTIKVTRGHSLFKYENGKIVEVKGDDVRFGDLIVVPKKLTCVDKEVVINIPKRLINADEEEIKDLVITKHKDKAFFVKLKKTLEDIENNKLKVIFDDCILYLKELGLIDYNIIKKINKVDIKILDEEKFKAYKKYFDTVIEHGNFKKGRCNIQYIKIKDYIANIPDKEFEDCEIGAYSGKINALLKLDEKLAKFLGFFVTRGRLKKQKLKGETVYEISVYKSLPEYQKEIAETFKEVFGAGSMVKDKVTMDNKIVYLVLKYIFKCGDKDKKHIPEELFLASESVIKSFLDGFLKAKKNSHKGTSTFMAKDEKYLNQLMILFNLVGIPTRFTPVKNKGYKLTLNPKYGTVKDLMLDEVKEIEAFEYSGYVYDLSVEDNENFLVNNIYAHN

SEQ ID NO: 518 - protein, 543 aa, Methanococcus jannaschii
  MISC_FEATURE (1)..(543): Mja_RFC-3
CLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHN

SEQ ID NO: 519 - protein, 494 aa, Methanococcus jannaschii
  MISC_FEATURE (1)..(494): Mja_r-Gyr
CLTPDTYVVLGDGRIETIEDIVNAKERNVLSLDLDNLSIKIDTAIKFWKLRYNGNLSKITLSNNYELKATPDHCLLVLRDNQLKWIPAKDIKENDYIAMPFNYKVERKPISLLNLLKYLDITDVLIEFDENSTIFEKIAEYIRNNIKTSTKYKYLRNRRVPLKYLIEWNFDLDEIEKEAKYIYKSVAGTKKIPLFKLDERFWYFAGLVLGDGSIQDSKIRIAQTPLKDVKSILDETFPFLHNWISGNQVIISNPIIAEILEKLGMRNGKLNGIIFSLPESYINALIAGYFDTDGCFSLLYDKKAKKHNLRMVLTSKRRDVLEKIGIYLNSIGILNTLHKSREVYSLIISNKSLETFKEKIAKYLKIRKEAFINGYKTYKKEHEERFECDLLPVKEVFKKLTFEKGRKEILKDSKIHIENWYKEKTNNIPREKLKTVLRYANNSEHKEFLEKIVNGDISFVRVKKVENIPYDGYVYDLSIKHNQNFISNGVISHN

SEQ ID NO: 520 - protein, 317 aa, Mycobacterium phage KBG
  MISC_FEATURE (1)..(317): MP-Be_gp51
CSWTNARAVTRRGFVHVDDLTTDDEVMSVDDQGRTIWQQIDEVVRFPFSGTLYSLGGREINATITANHRVVGLNREKTKWVEHTPTSLPGNKMWVYTAGEGSNEDYPLTDTEIRLAVWGLTDSHRSPDGRWTFYQSGEKAEQVRKLLADAGIEYRERARNRGITEIDGKVLKAPPKTQYEFSLGKVQELDDLLDRGRSELPTWTLSLSQRQARLFLEEYRFTDGTDTTSAGDSYVLYVCKDRMREQLQMLAAANGLRASTTEYRPGHWRLNISNRALSGLYKNTVEEVAYEGEVWCLRVPNGRFFIEDGGKIHLTGN

SEQ ID NO: 521 - protein, 407 aa, Anabaena PCC7120
  MISC_FEATURE (1)..(407): Nsp-PCC7120_RIR1
CLPEDALVHTAKGLVPIRDVQVGDLVQTPLGFRRVVDKFDQGFQDVYEIETNATYPRATLNHRQAVLEDAKGGIVWKHIASLEAGDRLLHNKQVLPGTVTHLPADFTESRPSHSRTAKSFVVPELTAEVAWLIGFTHGDGYVALGRNKYDKPYGRVEWSMNSLDAEVTSRIQAKIDAALALFGLSAVHSITKGENTAKSICSSIRLAEYFHRHIKQPNIPLTVPSFILQGSVDIRAAYLAGLMDSDGAVNNRPPHLITSVYRSFIRQVSVVLSSLGIAGRLTTTYPQNSNWQVKYNLTIPALKERYNALISPHSAKGELRQGLKMYGFTVPGAVMRETYTYSEMREMGFQGSRTVDANYERYVAEADISLDIPVTVKGLGSYDHVQTYDIEVDEAHCFYCDGYLTHN

SEQ ID NO: 522 - protein, 382 aa, Pyrococcus abyssi
  MISC_FEATURE (1)..(382): Pab_RIR1-3
CVVGETRILTPEGYIKAEELFKLAKERGKMEAIAVEGIAEGGEPYAYSLEILLPGDKQVKYETVHGNAVEVADPVSVPAYVWKVGMKEVARVRTKEGYEITATLDHKLMTPEGWKEIKDLKPGDKILLPRFEVEEDFGSESIGEDLAFVLGWFIGDGYLNVKDKRAWFYFNAEKEEEIAWKIREILAKRFEIKAEPHRYGNQIKLGVRGKAYEWLESIVKTNEKRIPEIVYRLKPNEIASFLRGLFSADGYVDNDMAIRLTSKSRELLREVQDLLLLFGILSKIYERPYKREFKYTTKDGEERTYTTEGYYELVIANYSRKIFAERIGLEGYKMEKLSLEKIKVDEPIVTVESVEILGKKLVYDFTVPEHHMYISNGFMSHN

SEQ ID NO: 523 - protein, 522 aa, Pyrococcus furiosus
  MISC_FEATURE (1)..(522): Pfu_KlbA
ALYDFSVIQLSNGRFVLIGDLVEELFKKYAEKIKTYKDLEYIELNEEDRFEVVSVSPDLKANKHVVSRVWRRKVREGEKLIRIKTRTGNEIILTRNHPLFAFSNGDVVRKEAEKLKVGDRVAVMMRPPSPPQTKAVVDPAIYVKISDYYLVPNGKGMIKVPNDGIPPEKAQYLLSVNSYPVKLVREVDEKLSYLAGVILGDGYISSNGYYISATFDDEAYMDAFVSVVSDFIPNYVPSIRKNGDYTIVTVGSKIFAEMLSRIFGIPRGRKSMWDIPDVVLSNDDLMRYFIAGLFDADGYVDENGPSIVLVTKSETVARKIWYVLQRLGIISTVSRVKSRGFKEGELFRVIISGVEDLAKFAKFIPLRHSRKRAKLMEILRTKKPYRGRRTYRVPISSDMIAPLRQMLGLTVAELSKLASYYAGEKVSESLIRHIEKGRVKEIRRSTLKGIALALQQIAKDVGNEEAWVRAKRLQLIAEGDVYWDEVVSVEEVDPKELGIEYVYDLTVEDDHNYVANGILVSN

SEQ ID NO: 524 - protein, 444 aa, Pyrococcus horikoshii
  MISC_FEATURE (1)..(444): Pho_IF2
CLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHN

SEQ ID NO: 525 - protein, 410 aa, Pyrococcus horikoshii
  MISC_FEATURE (1)..(410): Pho_r-Gyr
CVTPDTLVSLSDGRIIEIREAVENSEESLLGINGLKPKEAKALKFWEIDWDGPIKVIKLKNGHEIKATPDHGLLVMRDGKIGWVSAKNIREGDYVAFIYNLGHRGGKKYTLPQLLKELGISEYENSSSQELNNREQEMDSKQISIELDERFWYIFGVILGKGTLKGDKVVIFQKDVKPVIEEALPFVRIFESADHIGFSHLILAEVFRRLGVGEGKLHSLVFGLREEYINAMIAGYFDASGTFLRRAVLTSKRGDILRMLSVYLYQIGIVNNLRRDEHAGVWELIISDLEKFREKIYPYLRIKKSQFDKVYSISKNEGDFLPVASIFRKLKFRDGFKNRILDEEIPRDEVAKVLEYAEDSPEKEFLNSLVEARVTWVRVEKIEERHYTGKLYDFTTTTENFISNGIVSHN

SEQ ID NO: 526 - protein, 456 aa, Phaeosphaeria nodorum
  MISC_FEATURE (1)..(456): Pno_RPA2
CLSADHEVLTSTGWKALPAIKDADQVMTLDLQTGTQQWNSVQATTRFAREGSLYRLKSDDMDAVCNESHRWYLNTKDQPTTYTAFTTQQMLDNQLVALRNSSGKATDQWNHESGTTTHTNHNIPTVGHNGNVMFSWPDCPWLPREFVADEACNLDWCRFIGLVMGDGSIDHVTDAQGQEHYSIQIHQRAGNPASNANTEDVLERLAAKLPNFVVHPSCVSGAEEKHTWTINHRDMYHFFLPMMRGPQSYDPLDNAMCRTYQAPDYQALSRSDNEPIIPVPADWKTGNWWHLRRWINYPWLFSLAQSQARAMIKGMAAANGDWSLSLKARLDTGDSGVVRVFSNSIPLMHDMSVLGLLADTRVNIGVDHKKGQMQLQVPVTMPALLAWCISFSFANSDLAVAAPKPEAYDNPRHDGFVYCLTVPNGNFLARRTVEYSDNDKIQEVIDAAQKPFFTGN

SEQ ID NO: 527 - protein, 348 aa, Salmonella phage SETP3
  MISC_FEATURE (1)..(348): SaP-SETP3_Helicase
CLKRGTEVIMFDGTTKKVEDVIVGDVLMGPDSTPRNVLSLGRGREMMYEVKPRKGESYTVNESHILSLRTTTGIAKGSWPDNTVFDISVRDWLKLPKYVTGPNGYLKGWRVPVDFPRKEQDEALLPPYLMGLWLGDGTSSSGAITSGENEKEIRAYLESYAARNGMQIRKEGLTWSISHGNTGHKKHGFTHALKSAGVLNNKHIPHNYKCGDRRQRLELLAGLLDSDGYCDLSKAGFDWISVSERLADDFCYLCRSLGFAAYKKKTCKRCANTDVWGDYFRVSVSGDFSEVPFVRGRHQNLPKRNINKNVLNVGIESITPVGVDDYFGFTIDGDSRFLLGDFTVTHNT

SEQ ID NO: 528 - protein, 420 aa, Staphylococcus phage Twort
  MISC_FEATURE (1)..(420): StP-Twort_ORF6
CISMDSMILTTEGYKSLQEIFETQGVKVDNKEKVIELKYPLINRYGDVEYTSHFTKNGEKPTKRIKTNKGIELVNTYNHPLLVREGFNLIWKKSEDIEVGDILVSRVGDHQFGNNNTVENEEEAYALGCMVADSYLGSYSRLSFSNDKKEILDKVSKFWNTFSNKEVYYDTYKESKGITIHLHDTNKTKEFHDKYKIEYGVAKDKKIPKCIMESPENIQLAFVSGYLECESSISEKNLEVTSASKDLLKDLQLILSNIGIVSTNKEKVVKKYKHNKYYRLIVNRKELIKLLPLLRFETQQRKNQKENFLSNNTKIKSSYGNTIEGSRYLLKKYRDSLNIDKKEFSKYLSRDTITIDRLREVISLYPDGDKEIRELFENVVNNNIYYQKVEQVLEGEIIPTFDVCMPKTHSFIANTIVNHN

SEQ ID NO: 529 - protein, 428 aa, Trichodesmium erythraeum
  MISC_FEATURE (1)..(428): Ter_DnaE-2
CLSGSTKVIDAATGNLFSLKEIAAQPEYWLSRKVFSLDLKSQQVVQQPITEIHPNGVRDVWQITTRTNRKVCATDDHLFYTVLGWKPLKDFSVGDRLGLPNKIPINYRSQISDSKVKFTAYLIGEGYLYTNSFSCSYFCNSDGELIADFYGCAEELFGSSAPIEKQLHLGNKSVIYVRIGLISGLKNWVDSYLQCANSRVQEIPNWIFSLSQSQLQLFLGILWSTSGIFDETIGYTYYSSNSEVLVRQVQHLFLRLGIVSLFNVNKVKGQGELDVSYVVEVRGREDMLKFYKLIKPYLSSYKQGLCESCYLVIKYQQSYQFKYFLTPDFFDLIVKAKKASSMTRALGVCGGEISSVWNFQNTSNRSLSFDKFNNFSTVLADEELTAIANSDVFWDEIISIEYIGKEEVFDLTIPETHNFIANDFIVHN

SEQ ID NO: 530 - protein, 323 aa, Trichodesmium erythraeum
  MISC_FEATURE (1)..(323): Ter_RIR1-3
CVSGDTLLITRDSIHKIKDVVGQKIEIWNGKNWSQVIPLKTGKDRKLYRVRFGDGSYLDVTEYHRFFVKDRFGKKYEEVQTKDLLTHSKYALDVEPFIIDYHDGDSINLSYAYTLGAALGNGTIDQNSNGKIRVYSHKAELIFAGNKSLERQYNYLPSFVDVIDLGFSGELLRRLQTEPDALNTIASWNKSAILAFIAGLADTDGSETKGNGIKISVSDYERAKRLQLLLTKCGIRASVNLMASRGCTTNLGERNQDLYYLQITDCREIPCQRLDTTKVCEAKFQGKYQTIQNVEELPGLHDTYCFEEPEFHKGVFGNALTGN

SEQ ID NO: 531 - protein, 403 aa, Thermococcus kodakaraensis KOD1
  MISC_FEATURE (1)..(403): Tko_Helicase
CMHPDTYVVTKSGAKKVSELTEGDEVLTHTGTFKKVIQPLRREHKGRLLVIKAYGTVPVKITPEHMVWVVKQIRHKSHYSDGRQVIWWEFEGPEWMTAQELKERLESETDPKVSYMLLQPIPEPSVDADKIPLRKEVYVVNQHGKTDKLHPSVKRTPEYLPLNFETARLIGLWIAEGSTSKNGVIKFDISSNEEDLTEFITGTIRKYFPHAKIVVKDHERNRRTVRFCNKRFAEWLRENIGHGADNKSIPPLLLLNKNREVRLGLLRGLIEGDGYVRRESQRRANYISYSTVSPSLAYQLQLLVASLGYTSSIHRSIRTEGIGKTRKPIYDVKVSGKSYYSLLEELGFEVPQRGNRTYNVNRTWKNYLLLKVRSIEEEEYEGDVYNLEVEGDESGSVGFIVHN

SEQ ID NO: 532 - protein, 536 aa, Thermococcus kodakaraensis KOD1
  MISC_FEATURE (1)..(536): Tko_Pol-2_Pko_Pol-2
SILPEEWLPVLEEGEVHFVRIGELIDRMMEENAGKVKREGETEVLEVSGLEVPSFNRRTNKAELKRVKALIRHDYSGKVYTIRLKSGRRIKITSGHSLFSVRNGELVEVTGDELKPGDLVAVPRRLELPERNHVLNLVELLLGTPEEETLDIVMTIPVKGKKNFFKGMLRTLRWIFGEEKRPRTARRYLRHLEDLGYVRLKKIGYEVLDWDSLKNYRRLYEALVENVRYNGNKREYLVEFNSIRDAVGIMPLKELKEWKIGTLNGFRMRKLIEVDESLAKLLGYYVSEGYARKQRNPKNGWSYSVKLYNEDPEVLDDMERLASRFFGKVRRGRNYVEIPKKIGYLLFENMCGVLAENKRIPEFVFTSPKGVRLAFLEGYSSAMATSTEQETQALNEKRALANQLVLLLNSVGVSAVKLGHDSGVYRVYINEELPFVKLDKKKNAYYSHVIPKEVLSEVFGKVFQKNVSPQTFRKMVEDGRLDPEKAQRLSWLIEGDVVLDRVESVDVEDYDGYVYDLSVEDNENFLVGFGLVYAHN

SEQ ID NO: 533 - protein, 186 aa, Thermoplasma volcanium
  MISC_FEATURE (1)..(186): Tvo_VMA
CVSGETPVYLADGKTIKIKDLYSSERKKEDNIVEAGSGEEIIHLKDPIQIYSYVDGTIVRSRSRLLYKGKSSYLVRIETIGGRSVSVTPVHKLFVLTEKGIEEVMASNLKVGDMIAAVAESESEARDCGMSEECVMEAEVYTSLEATFDRVKSIAYEKGDFDVYDLSVPEYGRNFIGGEGLLVLHN

SEQ ID NO: 534 - protein, 152 aa, Synechococcus vulcanus
  MISC_FEATURE (1)..(152): Tvu_DnaE-N_NC-terminal
CLSGETAVMTVEYGAIPIRRLVQERLICQVYSLDPQGHLYTQPIAQWHFQGFRPVYAYQLEDGSTICATPDHRFMTTSGQMLPIEQIFREGLELWQVAIAPPGALAQGLKPAVQMSCMKIVGRRLVGWQAVYDIGLAGDHNFLLANGAIAAN

SEQ ID NO: 535 - protein, 307 aa, uncultured archaeon GZfos9C4
  MISC_FEATURE (1)..(307): Unc-ERS_RIR1
CVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLFDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHN

SEQ ID NO: 536 - protein, 307 aa, Artificial Sequence
  Synthetic construct Unc-ERS_RIR1_var7
CVTADTWVTTAEGPRQVEELIGKKFTAIVNGEEWESSEEGFFETDVKPVYTLKTAEGFELRLTADHPVMKVERMTRYKVETQWSNAGDLKPGDKIIINNHRDFGNWSVKGKYTEGEGYLIGLLLGDGTIKKLNPWMKAISKKMEKASADFCEGILRGLSDADGSVQGNQSKGVSIRLAQSDVEILKAVQRILLRFGIFSKVYMNRRGERKVKMPDGKGGVKEYITKPQHELVISNDNILYFAERVGFSDAEKMEKLEKAIWNYKRKMNRERFVASVEEVVPDGVEKVYDVKIPGINAFNANGFVVHN

SEQ ID NO: 537 - protein, 88 aa, Marine metagenome
  MISC_FEATURE (1)..(88): gp41-1-N
CLDLKTQVQTPQGMKEISNIQVGDLVLSNTGYNEVLNVFPKSKKKSYKITLEDGKEIICSEEHLFPTQTGEMNISGGLKEGMCLYVKE

SEQ ID NO: 538 - protein, 37 aa, Marine metagenome
  MISC_FEATURE (1)..(37): gp41-1-C
MMLKKILKIEELDERELIDIEVSGNHLFYANDILTHN

SEQ ID NO: 539 - protein, 91 aa, Marine metagenome
  MISC_FEATURE (1)..(91): gp41-8-N
CLSLDTMVVTNGKAIEIRDVKVGDWLESELGPVQVTEVLPIIKQPVFEIVLKSKSGKKIRVSANHKFPTKDGLKTINSGLKVGDFLRSRAK

SEQ ID NO: 540 - protein, 45 aa, Marine metagenome
  MISC_FEATURE (1)..(45): gp41-8-C
MCEIFENEIDWDEIASIEYVGVEETIDINVTNDRLFFANGILTHN

SEQ ID NO: 541 - protein, 101 aa, Marine metagenome
  MISC_FEATURE (1)..(101): IMPDH-1-N
CFVPGTLVNTENGLKKIEEIKVGDKVFSHTGKLQEVVDTLIFDRDEEIISINGIDCTKNHEFYVIDKENANRVNEDNIHLFARWVHAEELDMKKHLLIELE

SEQ ID NO: 542 - protein, 40 aa, Marine metagenome
  MISC_FEATURE (1)..(40): IMPDH-1-C
MKFKLKEITSIETKHYKGKVHDLTVNQDHSYNVRGTVVHN

SEQ ID NO: 543 - protein, 105 aa, Marine metagenome
  MISC_FEATURE (1)..(105): NrdJ-1-N
CLVGSSEIITRNYGKTTIKEVVEIFDNDKNIQVLAFNTHTDNIEWAPIKAAQLTRPNAELVELEIDTLHGVKTIRCTPDHPVYTKNRGYVRADELTDDDELVVAI

SEQ ID NO: 544 - protein, 40 aa, Marine metagenome
  MISC_FEATURE (1)..(40): NrdJ-1-C
MEAKTYIGKLKSRKIVSNEDTYDIQTSTHNFFANDILVHN

SEQ ID NO: 545 - DNA, 1467 bp, Artificial Sequence
  Synthetic construct intein-modified proSavinase_S135:Cth_ATPase_BIL
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcttcgtggcgggcactatgatcctgacagtcgcggggctggtcgctattgagaatattaaggcgggggacaaggtcatcgctactaacccggagacattcgaggtggctgagaagaccgtcctggagacctacgtgcgcgagaccacggagctcctgcacctgacgatcaatggcgacgtcattaagacaactttcgagcatctcttctacgccaaggatgtcgggttcgttgaggcgaaggagctgcaggtcggcgacaagctcctggattccaaggggaacgtgctcgtggtcgaggacaagaagatcaagattaccgatgagcccgttaaggtgtacaatttccaggttgatgacttccacacataccacgttgggtgcaatggggttctcgttcataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 546 - DNA, 1704 bp, Artificial Sequence
  Synthetic construct intein-modified proSavinase_S135:Hwa_rPol_App
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctattgaggctgatgagtcaatcgttattaggcgggacggggagactgagctgacggagatcgggtcgttcgtggacactattctggccgcggacaaccaggagacccggatcacggatggccacgagattgcgctcgctccgaatgggctggaggttccctccctcgacaccgatgagcagatcaggtggaagcacattgaggcggtgagccggcatgcttcgccagacgagatcctcctgattgagctggagtcaggcaggtccatcagggctaccaaggctcactccttcgtcacgaggagggacggcgatgttctcccagtggctggcgagacactggtggtcggggacgtcctccctactgttggcagctacgatcatgcgtcggggtctatctcagtgccgctgcagtcccagagcgtcgctgctgacggcgggaccgttgagcccaacacaaatatcactgccaacgcggagcgcgattcggcctctattacctctgcgggcatcattgggtcggctacgtgggagaggatctccagcattgagacagtggcgccggagtacgagtatgtgtacgatctctctgtttccgggctggagactttcactacgggggagggggtcgttactcataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 547 - DNA, 2346 bp, Artificial Sequence
  Synthetic construct intein-modified proSavinase_S135:Kra_DnaB
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctcactgcggggacaagggttctgcgggctgatacgggggcggagactactatgggggagctgttcgcgctgcaggctagggacgttccggtgtggtcactcgacgagtccctgcgctacgtccgcaggcacctcactagggttttcccaaccggggtgaagccagtcttccggctgaggactgctagcggcaagactgtccgcgctaccgctaaccatccattcctcacctacgatgggtggaagcctctcggcgagctgtcggtggctgacaggctggcggttccgaggcacgtgccagctccagagagggtggcttcatggacggacgatcaggtcctcctgctcggccatctcatcggcgatgggtccttcgtcaagaggcagccactccgctacgctagcgttgacgaggctaacctgtcggctgtgacggaggctgctgctaatgccttctccattgtcgcggttcgggacgagtacgctgctgctaggtgcaccacgctcaggctgccagctccttacaggctgacccacggcaggaggaatccactcgctgcttggctggacgagctcggcctgttcgggctcaggagctacgagaagttcgtcccgcaggaggttttccacctgcccaagaggcagatcgctctcttcctgcggcatctctgggcgactgatggctctgtgacgctgacaaggcagtcacgcggcgggaggatctactacgcctcgacatctctccagctgattcaggacgtctccaggctgctcctgcggttcggcattagcacgagggtgcggacaactaccccaaagggggaccacaggcctggctacacactcgatgtttctggcgtggacgatcagaggcggttcctgcaggagatcggcgtccatggggccaggggcgctaccgctgacaggctcctggaggtcatcagggatgtctccgcgaacacgaatgtcgacacagttcccaggcaggtttgggacgatgtgcgcaggctcctggtggagaaggagatgacgcacagggagttcgctgctgctatggggacatcgttcggcgggtccagcctctggaagcatgctccatctcgcgagaggctcggcagggtggcccaggtcctggactcggccgagctcgatgttctggcggtgaacgacgtcctgtgggatgaggtggtcgcgatcgagcctgacggcgaggagcaggtctacgatgctactgttctcggggggcacaacttcgtggcggatggcattgctgttcataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 548 - DNA, 1566 bp, Artificial Sequence
  Synthetic construct intein-modified proSavinase_S135:Mja_Klba
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggtgctctcgcctacgatgagcctatctacctctcggatggcaacattatcaatatcggggagttcgtggataagttcttcaagaagtacaagaacagcatcaagaaggaggacaatggcttcgggtggatcgatattggcaacgagaatatctacattaagtccttcaacaagctcagcctgatcattgaggacaagcggatcctccgcgtctggcgcaagaagtactcggggaagctgatcaagattaccacgaagaaccgcagggagatcacactcactcacgatcatccggtttacatctctaagaccggcgaggtgctggagattaatgccgagatggtgaaggtcggggactacatctacattcccaagaacaataccatcaacctcgatgaggttattaaggtggagacggtcgactacaatggccacatctacgatctgactgtggaggataatcatacttacattgctggcaagaatgagggcttcgctgtttccaactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 549 - DNA, 2490 bp, Artificial Sequence
  Synthetic construct intein-modified proSavinase_S135:Mja_Pol-2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggtagcattctccctgacgagtacctgactattattgaggaggatggcattaaggtcgtgaagatcggggagtacattgatgatctcatgcgcaagcacaaggacaagatcaagttctcgggcatctctgagattctggagacaaagaacctcaagactttctccttcgataagatcacgaagaagtgcgagattaagaaggtgaaggcgctgatcaggcacccatacttcggcaaggcttacaagatcaagctccggtctggccgcaccattaaggtcacgagggggcattcactgttcaagtacgagaacgggaagatcgtcgaggttaagggcgacgatgtgcggttcggggacctgatcgtggtcccaaagaagctcacctgcgtcgataaggaggttgtgatcaacattcctaagcggctgatcaatgctgacgaggaggagatcaaggatctcgtcattaccaagcacaaggacaaggccttcttcgttaagctcaagaagacgctggaggatatcgagaacaataagctcaaggtcatcttcgacgattgcattctctacctgaaggagctcggcctgatcgactacaacatcattaagaagattaataaggttgacatcaagattctggatgaggagaagttcaaggcctacaagaagtacttcgacaccgtcatcgagcatggcaacttcaagaaggggcgctgcaatattcagtacatcaagattaaggactacatcgcgaacattcccgacaaggagttcgaggattgcgagatcggcgcctactcggggaagattaatgcgctcctgaagctcgacgagaagctggctaagttcctcggcttcttcgtgacacgcgggaggctgaagaagcagaagctcaagggcgagactgtctacgagatctcagtttacaagtccctcccggagtaccagaaggagatcgctgagacattcaaggaggtcttcggcgccgggtccatggttaaggacaaagtgactatggataacaagatcgtgtacctcgtcctgaagtacattttcaagtgcggcgacaaggataagaagcacatccccgaggagctcttcctggcctccgagagcgtgatcaagagcttcctggacggcttcctcaaggccaagaagaacagccataaggggacctcgacgttcatggcgaaggatgagaagtacctcaaccagctgatgatcctcttcaatctggttggcattccgacaaggttcactcccgtgaagaacaagggctacaagctcaccctgaatccgaagtacgggacggtgaaggacctcatgctggatgaggtcaaggagatcgaggcgttcgagtacagcggctacgtctacgatctctctgtggaggataatgagaacttcctcgtcaacaacatctacgctcataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 550 - DNA, 2691 bp, Artificial Sequence
  Synthetic construct intein-modified proSavinase_S135:Mja_RFC-3
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctgacgggggacgctaagattactctgcctgacgagcgggagatcaagattgaggatttcattaagatgttcgaggagcgcaagctgaagcacgtcctcaacaggaatggggaggacctggtgctcgctggcgtcaagttcaactccaagatcgttaatcacaaggtgtacaggctggtcctggagagcgggagggagatcgaggctaccggcgaccataagttcctgacgagggatggctggaaggaggtgtacgagctcaaggaggacgatgaggttctggtgtacccggctctggagggcgttgggttcgaggtggacgagcgcaggatcattggcctgaacgagttctacgagttcctcacaaattacgagatcaagctggggtacaagccactcggcaaggcgaagtcatacaaggagctgattactcgcgacaaggagaagatcctctctagggtcctggagctctccgataagtactccaagagcgagatccggcgcaagattgaggaggagttcggcatcaagatttctctgaccacgatcaagaacctcattaatgggaagatcgacggcttcgccctgaagtatgtgcgcaagatcaaggagctcggctgggatgagatcacctacgacgatgagaaggctgggatcttcgccaggctcctgggcttcatcattggcgacgggcacctgtcgaagtctaaggagggccggatcctgattacagctactattaacgagctggaggggatcaagaaggatctggagaagctcggcatcaaggcctcgaacatcattgagaaggacattgagcataagctcgatgggagggagatcaagggcaagacctctttcatctacattaacaataaggccttctacctcctgctcaacttctggggggtcgagattggcaataagacgatcaacgggtacaatattccaaagtggatcaagtacggcaacaagttcgttaagagggagttcctgaggggcctcttcggggctgacggcacaaagccttacatcaagaagtacaacatcaatgggattaagctgggcattcgggtggagaacatctccaaggataagactctggagttcttcgaggaggtcaagaagatgctggaggagttcgaggtcgagagctacattaaggtttcgaagatcgacaacaagaatctgaccgagctcatcgtcaaggccaacaataagaactacctgaagtacctctcaaggatctcctacgcgtacgagaaggacaatttcgctaggctggtgggcgagtacctccggatcaaggaggcgtacaaggacatcattctgaaggagatcgccgagaacgcgctcaaggaggccgatggcgagaagagcctgagggagctcgctaggaagtacaacgtcccggttgacttcatcattaatcagctgaaggggaaggatatcggcctcccccgcaacttcatgacgttcgaggagttcctcaaggagaaggtggtcgacggcaagtatgtgtccgagcggatcattaagaaggagtgcatcggctaccgcgatgtgtacgacattacttgccacaaggatccttctttcattgctaacggcttcgtctctcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 551 - DNA, 2544 bp, Artificial Sequence
  Synthetic construct intein-modified proSavinase_S135:Mja_r-Gyr
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctgacaccggacacatacgtggttctcggggacgggcggattgagactattgaggacatcgtgaatgctaaggagcgcaacgtgctctccctggacctcgataacctcagcatcaagattgacacggcgatcaagttctggaagctgcgctacaacggcaatctgagcaagatcacactctcgaacaattacgagctcaaggctactccggaccactgcctcctggtgctgagggataaccagctcaagtggatccccgccaaggacattaaggagaacgattacatcgcgatgccgttcaattacaaggtcgagcggaagcccatctccctcctgaacctcctgaagtacctggacatcacagatgttctcattgagttcgacgagaactccactatcttcgagaagattgccgagtacatccgcaacaatattaagacctcaacgaagtacaagtacctcaggaaccgcagggtcccgctgaagtacctcatcgagtggaatttcgacctggatgagattgagaaggaggctaagtacatctacaagtccgttgccgggaccaagaagatccccctgttcaagctcgacgagaggttctggtacttcgctggcctggtcctcggcgacgggtcgatccaggattctaagatccggattgcccagaccccactgaaggacgtgaagagcattctcgatgagacgttccctttcctgcacaactggatctcgggcaatcaggtcatcatttctaacccaatcattgccgagatcctggagaagctcggcatgaggaacgggaagctcaatggcatcattttctcactgcctgagtcctacatcaacgccctcattgcggggtacttcgacaccgatggctgcttctcgctcctgtacgacaagaaggcgaagaagcacaacctgcgcatggtcctcacgtcaaagcggcgcgatgttctggagaagatcgggatctacctcaactccatcggcattctgaatacactccataagtctagggaggtgtactcactcatcatttccaacaagagcctggagactttcaaggagaagatcgcgaagtacctgaagattcggaaggaggctttcatcaacggctacaagacatacaagaaggagcatgaggagcgcttcgagtgcgacctcctgccagttaaggaggtgttcaagaagctcaccttcgagaagggccggaaggagatcctgaaggactccaagatccacattgagaactggtacaaggagaagaccaacaatatcccgagggagaagctgaagacggttctccggtacgcgaacaatagcgagcataaggagttcctggagaagatcgtgaacggggacatttcgttcgtgcgcgtcaagaaggtggagaatatcccgtacgatggctacgtctacgatctctctatcaagcataatcagaacttcatctctaatggggtcatttcacacaactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 552 - DNA, 2271 bp, Artificial Sequence
  Synthetic construct intein-modified proSavinase_S135:Tko_Helicase
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcatgcatcctgacacatacgtggttactaagtcgggggctaagaaggtctctgagctgactgagggggatgaggtcctgacacataccggcacgttcaagaaggtcatccagccactgaggagggagcacaaggggcgcctcctggttatcaaggcctacggcaccgtgcctgtcaagattacgccggagcacatggtttgggtggtcaagcagatcaggcacaagtcccattacagcgatgggcggcaggtcatttggtgggagttcgagggcccagagtggatgacggctcaggagctgaaggagcgcctggagtccgagacagacccaaaggtgagctacatgctcctgcagccaatccctgagccgtccgtggacgcggataagattcctctgaggaaggaggtctacgttgtgaaccagcacggcaagacagacaagctccatccgtccgtgaagcggactcccgagtacctgccactcaacttcgagaccgctaggctgatcggcctctggattgctgaggggtcaacttccaagaacggcgtcatcaagttcgacatttccagcaatgaggaggatctgacggagttcatcacaggcactattaggaagtacttcccgcacgctaagatcgtcgttaaggaccatgagaggaacaggaggacggtccggttctgcaataagcgcttcgcggagtggctcagggagaacatcggccacggggctgataataagagcattccgcccctcctgctcctgaacaagaatagggaggtgcgcctgggcctcctgagggggctcatcgagggcgacggctacgtgcgcagggagtcgcagcgcagggcgaactacatcagctactcgacagtttctccctcactggcttaccagctccagctcctggtggcttcgctgggctacacctcgtctatccacaggtctattcggacagagggcatcgggaagactaggaagcccatctacgatgttaaggtgtcgggcaagtcttactactcactcctggaggagctcgggttcgaggtcccacagaggggcaacaggacctacaacgttaatcgcacgtggaagaattacctcctgctcaaggtgaggtccatcgaggaggaggagtacgagggcgacgtttacaatctggaggttgagggggatgagtcaggctctgtgggcttcatcgtgcataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 553 - DNA, 2670 bp, Artificial Sequence
  Synthetic construct intein-modified proSavinase_S135:Tko_Pol-2_Pko_Pol-2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctattctgcctgaggagtggctgcctgttctggaggagggggaggttcatttcgttaggatcggggagctgattgaccgcatgatggaggagaacgctggcaaggtcaagagggagggggagaccgaggtcctggaggtttcaggcctggaggtgccgtccttcaaccgcaggacgaataaggcggagctgaagagggtcaaggctctcatccggcacgactactctggcaaggtgtacaccattaggctgaagtcaggccggcgcatcaagattacgtcagggcattccctgttcagcgtccggaacggcgagctcgttgaggtgaccggcgacgagctgaagccaggggatctcgtcgctgttccaaggaggctggagctgccagagaggaaccacgtcctcaatctggttgagctcctgctcggcacaccggaggaggagactctggacatcgtgatgacgattcccgtcaagggcaagaagaacttcttcaaggggatgctcaggacactgcggtggatcttcggcgaggagaagaggccaaggactgctcgcaggtacctcaggcatctggaggacctcggctacgtgcggctcaagaagatcgggtacgaggtcctggactgggatagcctcaagaattaccggcgcctgtacgaggctctcgtggagaacgtccgctacaacggcaataagagggagtacctggttgagttcaattcgatccgcgacgccgtggggattatgccgctgaaggagctcaaggagtggaagatcggcacactcaacgggttccggatgcgcaagctgattgaggtcgatgagtccctcgccaagctgctcggctactacgtgagcgaggggtacgcgcgcaagcagaggaacccgaagaatggctggtcgtactctgtcaagctgtacaatgaggaccccgaggttctggacgatatggagcggctcgcgagccgcttcttcggcaaggttaggcgggggaggaactacgtggagatccccaagaagattggctacctgctcttcgagaatatgtgcggggtgctcgctgagaacaagcgcatcccagagttcgtcttcacatcacctaagggcgttaggctggccttcctggaggggtactccagcgctatggctacctccacggagcaggagactcaggcgctgaacgagaagcgcgctctggccaatcagctcgttctgctcctgaactcggtgggcgtctctgctgtgaagctcggccacgactccggggtttacagggtgtacatcaatgaggagctgccattcgtcaagctcgataagaagaagaacgcttactacagccatgtgattcctaaggaggtcctctcggaggtcttcggcaaggttttccagaagaacgtgtccccacagaccttccggaagatggtcgaggacggcaggctggatcctgagaaggctcagaggctgtcgtggctcatcgagggggacgtggtcctcgatcgcgtcgagtctgttgacgtggaggactacgatggctacgtgtacgatctctctgtggaggataatgagaacttcctcgtgggcttcgggctcgtttacgctcataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 554 - DNA, 1620 bp, Artificial Sequence
  Synthetic construct intein-modified proSavinase_S135:Tvo_VMA
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcgtttcgggggagacgccagtctacctcgctgacggcaagacaattaagatcaaggacctctactcatctgagcgcaagaaggaggacaacatcgtcgaggctggctccggggaggagatcattcacctcaaggacccgatccagatctacagctacgttgatggcacgatcgtgcgctcccgctcccgcctcctgtacaaggggaagtccagctacctggtgcgcatcgagacaattggcgggcgctcagtgtccgtcactcccgtccataagctcttcgttctgaccgagaagggcatcgaggaggttatggcctcgaatctcaaagtgggggacatgattgctgctgtcgctgagagcgagtcggaggcccgggattgcggcatgagcgaggagtgcgtgatggaggcggaggtctacacctctctggaggctacgttcgaccgcgttaagtcaatcgcgtacgagaagggcgacttcgatgtgtacgatctgtcagttccagagtacggcaggaacttcattgggggggaggggctgctcgtgctccacaactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 555 - DNA, 1518 bp, Artificial Sequence
  Synthetic construct intein-modified proSavinase_S135:Tvu_DnaE-n_NC-terminal
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgcctctcaggggagactgcggttatgacggtggagtacggggctattcctattcggcggctggttcaggagcggctgatctgccaggtttactcgctcgacccacagggccacctgtacacgcagcctatcgctcagtggcatttccagggcttccgcccggtgtacgcgtaccagctggaggacgggtccacaatttgcgctactccggatcaccggttcatgaccacgagcggccagatgctgcccatcgagcagattttccgcgaggggctggagctgtggcaggtggccatcgctccaccaggcgctctcgctcaggggctgaagccggccgtccagatgtcctgcatgaagattgtgggcaggaggctcgtcgggtggcaggctgtttacgatattgggctcgccggggatcataacttcctcctcgctaatggggctattgctgctaattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 556 - DNA, 2103 bp, Artificial Sequence
  Synthetic construct intein-modified proSavinase_S317:Cwa_RIR1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtcgcgccggagacaaagatcctcacagacagggggcagatcgccatcgctgacgtcgcgggggagaaggtcaatatttggaacgggtcggagtggtctgaggttctcgtgaagaagacaggcgagaaccagccgctcctgaaggtgcacttctcaaatggcgagtccctggactgcacttactaccacaagttccatgtccaggagaactacaaggggaaggtcaagatcgttgaggctaaggacctccaggagggcgataagctgattaagtaccggctcccactggtggagtccgagaatgacatcgatttcccttacgcctacaccagcggcttcttctcgggcgacgggtctcatgatggcatggggaagccggagattgacctctacggcgagaagaaggagctcctgcccttcgtcacggttaggaacaagtactacggcgggtcatacggcgacaagtcctggcgcatcgagagggatgaggtggccgtctacgacgatgttaaccaggaccggatcgtgtgcaagctcccgctggatattcccgcgaagttcacagttcccgtgaatggctacactatccagagcaggctggagtggctggctggcctcctggacgcggatgggacagtcgctaggaacggcgacaatgagagcctgcaggttgcgtcgacccaccagcagttcctcctggacatccgcctcatgctgcagacgctcggcgtcgactctaaggtggtcaagatggatgagatggggtacaggtcgctgccagacggcaagggcgggtaccaggattacttctgccaggcgaagtaccgcctcctgatttccagcaacggcctcttccagctgggcgagctcgggctgaagaccaacaggctccagtggaatctgagggagcctcagagggaggcttcccagttcatcagggtggagaaggtcgagctcacctgccggtacgacgatacgtactgcttctcagagccaaagaggcatctcggcatgttcaatggcatcctcacagggcagtcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 557 - DNA, 2883 bp, Artificial Sequence
  Synthetic construct intein-modified proSavinase_S317:Dhan_GLT1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctcgcttcggacactctcgttcgcacatcggagggggacaagccagtcgctgaggtcgctatcggggactacctgctggacgctgaggacaagccagtcctctgcatgggcgctaacccttcccagaccgggcgcatgaaggagatcgcttaccaggacttcgattcgaagaagagggtgtctttcaagtgcacaccggaccaccacctggagctgacactcactgattccactccctccctcagcggcaagtcagtcacctggttctccaggtgcacgggggctcacctcagcgaggaggtgtcggaggtctacctggacaacatggtttcgatcttctacaatgatctggttgactcgacggattctgcggtggacaaggattccattcacgaggccgtggacctggcgctggaggatcactaccataggggcaactctgaccagtactcaatccatctcaatgagtacatcagccggattgccgataaggagctgcagaacgagccggagttcatccgggagtgcattcacgacgccgcgaatcgcttcgtcatcacctccagcggcaacaggaatattaagtcggagtctttcgacgataagctcctgctctcacgctccaggtcgtctacagctgacagcgattcggactacgtgatcactgacgcctccgtccactctcattcaaacaattcatccgtctacctcgcctcaccagactccatgatccctgatggcgctgccaaccgcttcgagaatattgcgtccaagctgaaggagccagtgtgcaactgcggcgggatccggaagattttccgcagcttcggcaccacggaggacgctgagctcgcttactccctgctcctgagcgagcactactacaggctggacccacggttcgtcacagatggctacactttccaggcctcggttgagcagtacgagaacatgtgctctcaggaggtgcagaatatgcacctgaagctctaccgctcacctctcaagttcgtggagagggagcataactccgctgagctgccagtcgacccatacttcctgggcctctggctgggcgatggggacagctcggggacaactatcatgaccacggatcgggagattgtggtctggctcaactcctacgtcgagcgcctgaaccagaataagccggagggctgcttccccctcaagctgaccgagcagctgatctacggcgctgggcacacgtccaagagcgggcatacaactaaggtcgacgttaggaattacaagatctcttcaggcgatgctttcgtgcggtcggggacatactggaacccgattttcgacggcctcaagaagctggggctcctgaacaataagagcgctggcatcccccaggagtacatgaactctgacgagcagaataggctctcagttattgccggcctgatggattccgacgggtgctacgtgaagagccacaacacctaccgcttcacccagctcacggaggaccataagaagatcgtctacgatctgaaggagctcgccctgagctgcggcattaacaccacgggggtcgagctctcggttaagccgctgggcttcaataagcacaagcattctaccgagtatgtggtgtacctcggcaacgggagccagaagttccaggagctcctgctcctgccacggaagaagatggagatcagcaagaagcacgtgtcgctggacgcgcgccctttcacggttagcgacgtggaggatggcgagttccgggctattgaggtttcagggggggttttccagctcgctaataggctcgtggttgctaattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 558 - DNA, 1944 bp, Artificial Sequence
  Synthetic construct intein-modified proSavinase_S317:Fsp-CcI3_RIR1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgccagccatacgacgctctcgtttcaacgccatcggggctcgttcctatcggggctctcgtggagacagacgcggtcggcatgaaggtgttcgatgcgcacggcctcacacaggtcattgctactaagagcaacggggttaaggacgtgctgaggatctggacccgcgcgggccacgctctcgacgtcacggccgatcatctggtttggaggtccacaagcgctggcgctggggctttcgtgccagctggcgctctcagggctggggacacactggagtggcataggactattgctccaggcgagggggagatcacgagccgcgagattgctgaggctgctctcgctggcaggctgcaggctgatggcttcgtcgggcgctacgctgggaccaatgcttcgctcacgatcgaggcgatgaccgttccaacgaggctctacgacgctccactgccagtggtcgctgcctacctcaggtcactgttccaggctgatggctacgtctcgcgcagggagaggtctaccctcatcggcctggacatgatttccgaggggctgatcaggggcgttcaggggctcctggctaggttcggcatcttcgccagggtgcggagggaggctgatccacgccctgacaggcacgatctctggtccctgggcattcagaacgctggggacaggcggaccttcgccgatgagatcggcttcctcgacccagtgaaggcggctaagctggaggcttccttcgaccagccaggccaggctgctaagcctgtcaagaggctccagatcgagaggattgagccgaggggcccgatgcccgtctacgacattcagacagattccggggagtacctctctgctgggctcagggttcataactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 559 - DNA, 1923 bp, Artificial Sequence
  Synthetic construct intein-modified proSavinase_S317:Gob_Hyp
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgccagcctgcggggacacaggtcgctaaggttattaaggaggggaggtggagggaggattcggttattgagcaggttcctattgagtcactccagccaggcgacagggtggtctccttcgggaacgcgaagatctaccgcaggggccgcgctgtgacagggattacttcccggcgccacacaggcaatctgcatagggtcgaggttggggagttccgcaccagggccacgccagagcacaggttcaccgtccggttcgacccagctaggcctaaggctggcctcctgtacctcatgaggaggggcgataggtggagggtgggcgtctgcgggatgttcaactcgcgcggcttcggggtttccgtgcggctgagccaggagaggggcgacgctgcttgggtgctcggggccttcgcgacactgactgaggctaggatcgccgagcaggttgtgagctgccggtacggcattccaaccacggtctgggagaccggcaggaatcctggggcttcgtgggctcagagggaccaggctggcatcgatgccatctaccagaggctcggcgtcgataggatccgggctggggttgacaggctcctgagggatcacggcctctctgctgggctgccactcctggctgccaacgagcccggcaatttctcgtgcaggcagtctaggcaggtggctgcttgcaacctggtgccaggcgtcatgcaggtcccagttccaacggctggcgagaggttcgagtggagggacctcaccgctacgagcttcgagagggttcatgatctggaggtgtggagcatggatgtggagagggataagcattacgttgcggatggcatcgttgtgcataactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 560 - DNA, 2298 bp, Artificial Sequence
  Synthetic construct intein-modified proSavinase_S317:Gvi_RIR1-1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcttcgctgcggggacgctgctgcatactgagcagggctacgttccggtggagcaggtcgtggcgggggtcgggacaagggtttgcacacaccagggcttccggaacatctctgagcgcttcgataatggggaggccgaggttttcagggtgaccacgcggaagggctactccgtggaggtcactgcgaaccacaagatggctcgcctcgacgagaatggcgatctcctgctcgacgagctctcacatctgcaagtgggcgacaacctgctcctgctcctggggtccaatccggtgaccgagaaggtccggctgcagtgcatcccagctggctaccgctccagcatcgagattgctcagccgcccgagctcgatgagcagctggcttacctcctgggctacgcctacggcgacgggtgcgtcggcaggggggctacatacaactacctcagcctggctgtgtcgcacacttacccgaatgtccgcgaccagctcgccgcgatcattagggagaagttcggcctgacaactaagatctactcaggctccggggcggtttggaacctcctggtgcattccgccaatctcctggattggctcaaggcgaacggcctcctgaagcagaaggctgcggacctcgccatgccagaggcgattctgcgctcgccttcgtctgtggtcggcgctttcctgtctgggtacttcgacgctgatggctgcgtgaggggcgggaagggcgggtacgggttcgattgcacgagcaaggctttcgtcggcgctgttcagctcctgctcctggccgaggggatcgtgtccaacctccacaccacggaccggagccgccagggctggcgcacaatctacaggctcaatgtctgcggcaccgagttcaagcgcaggttccagacgctgtgctgcaggtctgcgaaggttgtgcattcaccaatggtgctcggcagggatgggaccggcgggtacccacctgctctggttaggggcgcttcgtaccagagggtcgttgctgtcggcgggaagcacctcctgtacacggcgctcctgaaggtcatcgagaagacaaggactgctggcaagcaggctctcgctgagagcctgtgccagcatgtcaactacttcccggaccccatcgtcgcgattgagtcggttggcacgcagagggtttacgatattgaggtggagggcatgcatctgctcggcaatggcatctacacaagcaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 561 - DNA, 2538 bp, Artificial Sequence
  Synthetic construct intein-modified proSavinase_S317:Hhal_DnaB-1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctcgcctacgacgcggagatcgttcaggctgacgggggggttaagactattgagcagatcgttagggagcggcgggcgcatctcgctacggtcggcgctgactggaggctgacatggactgagccgtgcgattacgttgacgatggccacaagcccgtcttcgaggttaccacgcgcctcgggcgcaggatcgagacaactctgacacacccgttcctcactgtccatggctggcagaggctggaggacctcgctgagggcgatgctatcggggtcccaaggcagctgccagttttcggccaggagcccattagggactgcgaggtgaggctcctgggccacctgatcggggatggcgggctcaccggctcgccacccaggctgacgtctgggcaggaggcgatgacagctgacttcctggaggctgtggatgctttcggcggggtcgaggctaagccaatcagggcgtcccggaggacgcagagctgggtggtcgttggcgctgctcaggcccgcgctgctgctaggtccagcttcgcttcactggtcgacgccctcattaggaggtcccctctcaccggcagggctatcgctaggaacctgggggtggcgccagctaccctcacgtactggaggcagggcgtgaatgtccctgacgctgctatggttgggctcctggctggcgagctgggggttgatgtgggcgagctcaggccagagcctgtggctcgcaggaacgaccgcaatccactgcaggcttggctcgataggctgggcctcgctgggaagtccgctcacgagaagactgtgccagactgcgtcttccggctgcctcgcgagcagctcgctaggttcctgaaccggctcttctcgtctgacgggtgggtgacacatctggctagcggccaggggcagattggctacaccacggtctcggaggctctcgctaggcagatccagcacctcctgctccggttcggcgttctggctaagctcaggcataggtccgtgcgctaccaggacggcaggaggccagcctggcagctggatattactcacgcggagagcatcctcaccttcgctgagcagatcggcattctggggaaggagcagcggctcgcctctgttgctgcttcagtgcgcggcaggaggaggcagtcgcacacggaccatatcccctgcgagatttggcagttcatcgatagggccaggggcgagtggacatgggctgagctggctaggagggctggggtcgcttcatccaatatccacgcctacaggaggggcatgtctaggcagaggctggctgctttcgctgacgctctcggctcaagggagctgaggcagctcgcgagctcggacctgtactgggatcggatcgcctccattcgcccgctcggccataagcaggtgtacgatctcactattccagagactcataacttcattgctaatgatgtttgcgtgcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 562 - DNA, 2493 bp, Artificial Sequence
  Synthetic construct intein-modified proSavinase_S317:Hma_CDC21
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtgcatggggatacaagggttactctcgctgatgggcatgagcggcctattcgggaggtcgtggagtcaaatctggatgatccgaagccagtcgacgatggggtttgggataccgtggacttcgatgtcccttctctgcagtcagacggcacagttgcgactcagaacgctacgaaagtgtggaagcggaaggcgccggagacactctaccgcatcaggaccgctacgggcagggagctggatgtcacaccatcacaccctctcttcgttcagtccgacgggaggttccaggctaggaaggctgaggagctggagtctggcacccatgttgctgtgcccaggaaggtttcaactaacgcctgcaatgagctcgacgtcaccttccggcagtctcaggcccacaaccgcatcgacctcgatctgccaccacagtggacgccagagctcgctaggctgatcgggtacattgttgcggagggctacgtggagcagaggcctgataatacgggctacgtgtccatcacaaacaatgaccgggaggtgctggacgatgccaagagcgtcctggagactctcaacctgaatgtcaccgagcgctccagccacgaggggaagacggcgagggagctcctgtgcagcgctggcgagttcgtgtccttcctcgccagcctggacgagacactcctgcagtcgtctgctgagaggagggtcccgcaggatattatgagggcttccgacaacgtggtcaccgggttcattcggggctacatcgagggggagggccatgtgtcaacgtcccagcgcgagatcacagtcgcgagcatgtcgaagccgctcctggaggacgtcaggaccctcctggttacgcagggcattacagcccagctgcagccccggaacaatgggtcctacaggctcaggatctccggccagagcttccacgactacgcggagcagatcggcttcattactgcccgcaagaccgaggcttgcaggcagttcgaggggacgcatggcaacacaaatctggacattgtgccgaacctgggcccagagctcaggcgcatccgcgaggctctcgggctgactcagagcgagtgcggcctcccaaggtcgacctaccagcactacgagaggggcaggaggaatccctcgcgggattctctggagtcagtgctcgacgctttcgagactaggctggccgagatgaacaatgacactccaatttcggataccgctaggtctgacggcgggggcacgggctcgctcaggcaggatctcaacgggctggctgctctcgtggagggcgacatcgcctgggatcgcatcgagtccattgagcctatcgagcatgacgagaagtgggtctacgatctggagattgagggcacacataactacctcacaaatggggtcgtctctcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 563 - DNA, 1689 bp, Artificial Sequence
  Synthetic construct intein-modified proSavinase_S317:Hwa_MCM-1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgattgcctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 564 - DNA, 2136 bp, Artificial Sequence
  Synthetic construct intein-modified proSavinase_S317:Hwa_PolB-2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcttcactcctgatacaaatgttctgacgcctaatggggttcgcaatattcgggatctcacggtcggggattcggtttactcgctgaacccggagaccatgcagatggagatcaagccggtgacacagactcacgagtaccccgactaccagggcgacctcatcgatattcagacaaacgagatcgatttccgcgtcactccaaatcataggatgctggttgaggctaccggcacggacaccacgtccaccaacgactacgatttcatcgaggccgggaatctcgatatttccagccggtacgagctgcctcacggctggtccgttgaccatacggatagcctcggggcctacatcgacctgattaccctcctgagggagcagtcagacacgtacaacgtcctctccgatggcgggatgacaactgctgctacggctgacatcaatcacaacaatgtcacccgcagggttgactctgatacgttcgtgtcactgattggctggtatgtggctacagggcgggtctcgcgcactcagaacggctctgacagggtctacctccagctgtcccagacaaatactaaggcgcggacccagctcacgatgctcctggacgagctgggcgtggactggcaggctgataacgagaagatccacttcgtgtctcatgtctggacggagctcttcgacaccacgtgcggccgcacagagaagaacaagcacatcccggagctgattttcgacgcttcagcctcccagaagagggcgttcttcgatgctatcattaacggcagcggggtcaagaatgacgattcgtaccagtaccacacctcgtctgaggacctcagggacgatatcctccggctgtgcgttcatatcggcattgtggcgcggtacgactacatcaacgatgagtcctggcgcattgagtgcaccgagacggccaatcccgacttcacactgactcatagcggcaggcagtcgacagctgaggatggggtttactgcgtgactgtggcggataatcagactctgctcgccgggaggaatggcaccttccagtggacaggcaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 565 - DNA, 2286 bp, Artificial Sequence
  Synthetic construct intein-modified proSavinase_S317:Hwa_RIR1-1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctcactgcggactcaacagtcatgctcaaggagaaggggatggtctcggtctcggaggtggagacaggggatcagatcgctcagcgctccgacacaggcttccagtacaagccggtggaggagactcacgcgtacgagaacgctgagacactcactgtcaccctgacgaacggctgctctatccgcgggaccccgaatcacaggctcatggtcgacgatgagtggacgcgcatcgacgagattcagcccgatcaggaggttcattacacactcggctggctgagggagactaaccagtccccgcccaagctccactctcagtcacataccacggtgaatcagacagctgactccatcagcccggattccagcgagcccattgagctgtcggagtctgagaacgcggacacgggcaacaggcacaattctgctgttgccgtgaagcagtcacggacacagactcagctgatcagcgacgaggtggtctcgcggccagagcacaccaggaggcctgatcagctctccgaggagctggctgagctcctgggcctctggatcgacacggggctgtggcatcagagcggcgtccagttcaacgttgagcgcgagaatatcgcggagtacattgaccagctctcacagcagctgttcgataccccagctgctatctccgacacggatggcacctacacggtggacattacagatcataagctcaaggagtggtggaaggctaacttcggcgggaagccagacggcactcagtcgtcttacgtcccacagatgatcaaggaggcccctacaaatgttattgaggcgttcctgagggggtgcttcactgctgagggcgggctcaggaaggacatgaggccacggctgtgcacctcatccgaggatagcatcgacgatattgcggtcctcatgatgggcctggggtaccctgtggagaagtcggtcatcaggaacgctgacggcgagccgtactactcggttatgcccgctaccgacgatgggctctctgccttcctgcacgacgtgggcttcatcgatgagcggcgcgagatcgggctctccaacattgagagctcggatagccgggccctgaacaatacccataagatcgaggttgagtcaattgtggagtccccacctgcgacggtctacgacattacagtggcggataatcatgagtacgttacagatggcatcatttcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 566 - DNA, 2376 bp, Artificial Sequence
  Synthetic construct intein-modified proSavinase_S317:Hwa_RIR1-2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtggaggagaatagcctggtttctaccgatgaggggctgcggcctatcaaggatctggacaatactactgcggagttcgagcagtgggacgagatcgatgtcggcgttaccacggacggcgggaccaagacggctacagctgtttacgataacggcttcgccaatgtgcgccagatccagaccgagagcgggttcaacattgctgctaccccaaatcaccggttccgcacgctgtccagcgacggcacttacacctggaaggaggctggcaagttcgagtccggggaccgcgtgatcctgcagaggaacaccttcgatgctggctcccgcgtgtccctggaggctaatgagagggctgacgatgcccaggacacaactgagggcccagagctgccagggaggatgacgtccgagctggccgagttcctcggctacttcatgggcagcgggtacatctcggacgagacccatgcttccgtggatctggtggtcgacagcgatgccacggagctcaactcatacctgtccaatctcggcgagcagctcttcaggattaccccggccgtcgagtctcaggagatgtcacaggttctgtccttccgggactgccacctcagccgctacttcgaggataacggctggaagaagacggacacaggccataatggggatgcttcggctgctttcgtcccagagcagatcctggagggcgacgagcaggttgtgaacggcttcctcaggggggtgttcgaggcgattgggacggtctcggagaagatcgagattctgaccacgtctacaactctggctgaccagctccagagcctcctgctctcgctgggccacgtgttcacccgggatagcacgaagctcgtcgagacaaacaattaccatgacgatcagctgaggcagaggctctgcggcgctactaggagggaggacgagcggttcatgaacgagatcgggtcactcattgagccagatgagctgaacctctccacacgcgcggacaagaatgatacttacccttcgtctgttatcgaccacgtgcagacactggacggctacgattcagtgtccgagagcctcaagtctcgcattaaccagtcacaggtcgacgggacggttagcaggaagctgatcaaggatattgaggcggagactgctgagaccgtctcgatcgccgaccatgagctcacaggcttctacgcggctactgtggagtctgtcacggaggacacagcgtacactaaggatatttcagttccaagcaacaacacatacatcgccgacgggttcgttactcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 567 - DNA, 2346 bp, Artificial Sequence
  Synthetic construct intein-modified proSavinase_S317:Kra_DnaB
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctcactgcggggacaagggttctgcgggctgatacgggggcggagactactatgggggagctgttcgcgctgcaggctagggacgttccggtgtggtcactcgacgagtccctgcgctacgtccgcaggcacctcactagggttttcccaaccggggtgaagccagtcttccggctgaggactgctagcggcaagactgtccgcgctaccgctaaccatccattcctcacctacgatgggtggaagcctctcggcgagctgtcggtggctgacaggctggcggttccgaggcacgtgccagctccagagagggtggcttcatggacggacgatcaggtcctcctgctcggccatctcatcggcgatgggtccttcgtcaagaggcagccactccgctacgctagcgttgacgaggctaacctgtcggctgtgacggaggctgctgctaatgccttctccattgtcgcggttcgggacgagtacgctgctgctaggtgcaccacgctcaggctgccagctccttacaggctgacccacggcaggaggaatccactcgctgcttggctggacgagctcggcctgttcgggctcaggagctacgagaagttcgtcccgcaggaggttttccacctgcccaagaggcagatcgctctcttcctgcggcatctctgggcgactgatggctctgtgacgctgacaaggcagtcacgcggcgggaggatctactacgcctcgacatctctccagctgattcaggacgtctccaggctgctcctgcggttcggcattagcacgagggtgcggacaactaccccaaagggggaccacaggcctggctacacactcgatgtttctggcgtggacgatcagaggcggttcctgcaggagatcggcgtccatggggccaggggcgctaccgctgacaggctcctggaggtcatcagggatgtctccgcgaacacgaatgtcgacacagttcccaggcaggtttgggacgatgtgcgcaggctcctggtggagaaggagatgacgcacagggagttcgctgctgctatggggacatcgttcggcgggtccagcctctggaagcatgctccatctcgcgagaggctcggcagggtggcccaggtcctggactcggccgagctcgatgttctggcggtgaacgacgtcctgtgggatgaggtggtcgcgatcgagcctgacggcgaggagcaggtctacgatgctactgttctcggggggcacaacttcgtggcggatggcattgctgttcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 568 - DNA, 2202 bp, Artificial Sequence
  Synthetic construct intein-modified proSavinase_S317:Mca_RIR1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgttacggctgacacatgggttatgacggcctcgggggctaggcaggttcgggatctcattgacaggccattcgaggcggtcgtggacggcgagtgccacccaacagagtcccgcggcttcttcttcactggggataagcctgtgctcaggctgtcgacggctgagggccacacactcaggctgactgcgaaccatccggttctcagggtgtccaagatgaccaggcagctgcgggagacggagtgggttaaggctggcgagctcaggccacacgacaagatcgtcctccacgatcatagggctctgccatcctgggacggcgctcataccgaggctgagggctacctgatcgggctcctgattggcgggggcaccctcacgagggacaaggctatcctgtctatttgggatgctgctgctccaaaggtggctaacgggggcggctcagtcccagctgctggcgtcgccggggttatgagggctgctgagctcgctgctcggaccctgccacaccgcacggacttcaatggctggcagaccacgatggagggcaggggggagtaccacatggctacaggcgccctccatactctcgctctggagctcggcctgacaccaggggataagcgcctcactgcgcctctggagacaacttccagcgctttccacaggggcctcctgagggggatgttcgacgccgatggctcggttcaggggtctcagaggaagggcgtgtccatcaggctcccacagaccgacctcgggaacctgcagacggtccagaggatgctcctgaggctgggcgttgctagcaccattcatcagaataggaggccaggcgggaccaaggtcctcccagatggcgagggcggggctaaggggcactcatgccaggccgcgcatgagctgatcatttccggcgagaatgtggtcaggtacgctgagcggatcggcttcgccgactcggataagatggacaggctcaccgctctcctgcagaggtacaggcacacgaggcatgctgagaggttcatcgcgacagtgcagagcctggaggacgatggcatggaggccgtctacgatgttacagtggcggacgttcatgctttcgatgctaatgggctctacgttcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 569 - DNA, 1557 bp, Artificial Sequence
  Synthetic construct intein-modified proSavinase_S317:Memar_Pol-II
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcttcgcgggggacactgagattactgtttcggacgggcggcgctggatgtcgctccctattaggcagttcgttactgagaatttcgacatctcaaagccgggcctcgatcacgttgggacattctactccgacccaaggcagccattctacgtccgctcgattgattctcagggcaagacaagcctcaagcgggtgacttccgtcagcgttcacagggctccagctcatctggtccggttcgctaccaggagggggagggtcctcaccgttacgcctgaccatgcgatgctggtgtgggacacggattacctccgcaagatcaaggctctggaggtggctgtcggcgacagggttccagtggaggagggcgggctcgtggtcgctgatgaggttgtgtctagggagacggtgcaggctctggacgatcgggtctactgcctcactgtggcggagaatcatactctcgttgctaatggcatcttctgcgggcagtcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 570 - DNA, 1872 bp, Artificial Sequence
  Synthetic construct intein-modified proSavinase_S317:Mex_helicase
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcttcgctgcgggcactctcatcaagacaccaaaggggcctgttcctattgagcagattcagtcgggggatctcgttttcaatgcgatcggcattggggtggtcgagggcatcgtgtgccagcagaagcagaccattacgctggagctgtctgacggcacatcaatcgtctgcactcacgatcatccattcttctgccctcgcggctgggtcgctgctggcgacctggaggttggctccgggctgttcagccacgaggatctccgcaggctgtggtcgggcggggcttctctcggcctggagtccgggtccagcgacggcaggggggctgttcgctcgtctgaggtgctcctgaggatcctcagggaggaggctcgcgagccagatgctggctactgcgggccagccgaggacgtgcgcaacgcgtctaccgatagggctcatgctgagggcgcttggtggcagtggcaggctgacccgattgcgtcagatgaggctgctaggtccgctggcaggagggtcgctgaccgcgttagggacgaggataggagggaggctaggccagagccaaccgctgtcctcctgcaggacaggcactgcgagccactggctaacgatcggaataggagcggcagggagcattcatcccggggcacgggggaggctgagggccagcggcagggggacgtgccatgctcggtccgcgttgtgagcatctcgcgcgaggagaggggcgggcctgaggcggtgtacaacctcagggtttcagggcatccaagctacttcgctgggggggttctcgttcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 571 - DNA, 1557 bp, Artificial Sequence
  Synthetic construct intein-modified proSavinase_S317:Mhu_Pol-II
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcttccatggggacacactcattgagatctacgctgacggcattctggaggagattccgatcaggcggttcgttctggagcatctggatctctcgcaggctggcgtggacgctctggggacgttctacgctgatccggtccggccagctcacgtgcgctccgtcgacacaggcgggatcccacacctccgcaagattacttccgttagcgtgcataaggcccctgcgaacctgatccagttctcgacctctaggggcaagaatctcctggtgacgccggatcatgctatgctcgtttgggacgtgtcctacctccgcaagatcagggccctggaggtcaagattggcgacgctgtcccagtttgggagtcaggggtggtcatctccgacaggatcgtcagcattgattacgttccctgcgaggacgagcgggtgtactgcctcactgtggatagggatcataatgttgtgggcaatggcatcttcactgggcagtcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 572 - DNA, 2298 bp, Artificial Sequence
  Synthetic construct intein-modified proSavinase_S317:Mja_PEP
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcattgagggggacgctaagattctgacggatcgggggttcctgaagatgaaggaggtttacaagctcgtgaagaatggggagaagctcaaggtcctcggcctgaatgctgagacactgaagactgagtggaaggagatcattgacgctcagaagagggaggctaggcgctacgagatcggcgtgtaccgcaagaataagaacaccaaggacacgatcaagattacaccggatcacaagttccccgtgttcgtcaacggcgagctcagcaaggtgcagctgtgcgacatcattgataacaatctctcagtcctgtccatcgactacattccaatgatcgaggagaagtacgagtccctcgctgaggtcatgtacctcggcggggctgtcctgagcgatggccatatcgttcggaggaacgggaagccaattcgggtccgcttcacacagaaggacactgaggagaagaaggatttcatcgagaaggttaagggcgacgtgaagctcatcggcgggaatttcatcgagatttcgaaccgcaacaatgtcatcgagtaccagacctctaggaagattccgtcagagatcctgggcttcattgaggttaatattaacacaatccccctctacgccactaaggacgagatcgccgatctgattgcgggcttcgttgacggcgatgggtgcctctccgggaagaggagggtggagatctaccagaactccagccacattaagaagatcgagggcctcatcgtcgggctctacaggctgggcatcattccgaggctgcggtacaagcggtcgtctaccgcgacgatctacttcaacaacaacctggagaccatcctgcagcgcacgcgcaggattaagctcgacaagctgaaggagttcaagaagccagtggaggacaagaagctgatcgatatttcgcagatcctccctgagctgaaggagttcgactacaagggctacctctacaagacctacaaggagaagctgttcatcgggattaacaagctggaggagtacctgtctaagatcgacaaggatggcattgagcgcatcaagcagaagatcaagctcctgaaggagagcgacatctactcgatcaggattaagaaggtcggcgaggattacggggaggtctacaatatcacggttaaggcggagaacgagttcaatcataactacgtggtttggactaagcattacacacctatcgtggttttcaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 573 - DNA, 2013 bp, Artificial Sequence
  Synthetic construct intein-modified proSavinase_S317:MP-Be_gp51
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgctcgtggacaaacgctagggcggttacaaggcgggggttcgtgcatgtggatgatctcactactgatgatgaggtcatgtcggtcgacgatcagggcaggacaatctggcagcagattgacgaggtggtccggttcccgttcagcggcacgctctactcgctgggcgggagggagatcaacgctaccattacggccaatcaccgggttgtgggcctcaaccgcgagaagaccaagtgggttgagcatacaccaacttccctgcctggcaacaagatgtgggtgtacaccgctggcgaggggagcaatgaggactacccgctcaccgatacggagatcaggctcgctgtgtggggcctgacagactcgcacaggtctcccgatggccggtggactttctaccagtccggggagaaggcggagcaggtcaggaagctcctggctgacgctggcattgagtacagggagagggctaggaacaggggcatcaccgagattgatgggaaggtcctcaaggcgccgcccaagacgcagtacgagttctcgctcggcaaggttcaggagctggacgatctcctggacagggggaggagcgagctgccaacatggactctctccctgagccagaggcaggctaggctcttcctggaggagtacaggttcaccgacggcacggataccacgtcagctggggactcctacgtcctctacgtttgcaaggatcgcatgagggagcagctccagatgctggctgctgctaacggcctcagggcttccacaactgagtacaggccagggcattggaggctgaacatctctaatagggcgctctcaggcctgtacaagaataccgtggaggaggtcgcttacgagggggaagtgtggtgcctgcgggttccaaatggcaggttcttcattgaggatgggggcaagattcatctcacgggcaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 574 - DNA, 2283 bp, Artificial Sequence
  Synthetic construct intein-modified proSavinase_S317:Nsp-PCC7120_RIR1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctccctgaggatgcgctggttcataccgctaaggggctggtccctattcgggatgttcaggtcggggatctcgttcagacaccgctcggcttccgcagggtggtcgacaagttcgatcagggcttccaggacgtgtacgagatcgagactaacgcgacctacccacgcgctacgctcaatcacaggcaggctgtcctggaggacgctaagggcgggatcgtttggaagcatattgcttcgctggaggccggcgataggctcctgcacaacaagcaggtcctcccgggcactgttacccatctgcccgcggacttcactgagagcaggccatcacactcccggaccgccaagtcgttcgttgtgcctgagctcacggctgaggtggcttggctgatcggcttcacacatggcgacggctacgtggctctcggcaggaacaagtacgataagccgtacgggcgggttgagtggtccatgaactccctggacgctgaggtcacctcccgcatccaggctaagattgatgctgctctcgctctgttcggcctctccgctgtccacagcatcacgaagggcgagaacacagctaagagcatctgctccagcattcggctggccgagtacttccaccgccatatcaagcagccaaatattcctctcactgtgccgtcattcatcctgcagggctccgtcgacattagggctgcttacctcgctggcctgatggactccgatggggctgtgaacaataggccaccacacctcatcacatcggtgtaccggtctttcattcgccaggtctcggtcgttctctcgtctctgggcatcgccgggaggctgaccacgacatacccccagaactctaattggcaggtcaagtacaacctcacgatcccggcgctgaaggagcgctacaatgctctcatttctccccattcagccaagggcgagctcaggcaggggctgaagatgtacggcttcacggttccaggggccgtgatgcgggagacgtacacatactctgagatgagggagatgggcttccaggggtcacggacagttgacgccaactacgagcgctacgtggcggaggctgacatctccctcgatattcctgtgactgtcaagggcctggggagctacgatcacgtgcagacctacgacattgaggttgatgaggctcattgcttctactgcgatggctacctcacacataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 575 - DNA, 2208 bp, Artificial Sequence
  Synthetic construct intein-modified proSavinase_S317:Pab_RIR1-3
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtggtcggggagacaaggattctgacgcctgagggctacatcaaggctgaggagctgttcaagctcgccaaggagcggggcaagatggaggccatcgctgtggagggcattgctgagggcggggagccatacgcgtactctctggagatcctcctgcctggcgacaagcaggtcaagtacgagaccgttcacgggaacgctgtggaggtcgccgatccggtttcagtgcccgcctacgtgtggaaggtcggcatgaaggaggttgcccgcgtgaggacaaaggagggctacgagatcaccgccacgctcgaccataagctgatgactccggagggctggaaggagatcaaggacctgaagccaggggataagattctcctgcctaggttcgaggtggaggaggacttcggctccgagagcatcggggaggatctcgcgttcgtcctgggctggttcattggcgacgggtacctcaacgttaaggataagcgggcgtggttctacttcaatgctgagaaggaggaggagatcgcctggaagatccgcgagattctggctaagaggttcgagatcaaggccgagccacaccgctacggcaaccagattaagctcggcgtcagggggaaggcgtacgagtggctggagtccatcgttaagaccaacgagaagaggatcccggagattgtgtaccggctcaagcccaatgagattgcctcattcctcaggggcctgttctccgctgacggctacgtggacaatgatatggctatccgcctcacgtcgaagtctcgggagctcctgcgcgaggtccaggatctcctgctcctgttcggcatcctgtccaagatctacgagaggccgtacaagcgggagttcaagtacaccacgaaggacggcgaggagcgcacatacacaactgaggggtactacgagctcgtgatcgcgaactactcccggaagatcttcgctgagcgcattggcctggaggggtacaagatggagaagctcagcctggagaagatcaaggtcgacgagcccattgtcaccgttgagtcggtggagatcctcggcaagaagctggtctacgacttcactgttccagagcatcacatgtacatttccaatgggttcatgagccacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 576 - DNA, 2628 bp, Artificial Sequence
  Synthetic construct intein-modified proSavinase_S317:Pfu_KlbA
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggtgctctctacgatttctcggttattcagctctctaatgggcggttcgttctcatcggggatctcgtggaggagctgttcaagaagtacgccgagaagatcaagacctacaaggacctggagtacattgagctgaacgaggaggataggttcgaggtggtctcagtctccccggacctcaaggcgaataagcacgttgtgtctcgggtgtggaggaggaaggtccgcgagggggagaagctgatccgcattaagaccaggacgggcaacgagatcattctcacacgcaatcatcccctgttcgccttcagcaacggggatgtcgttaggaaggaggctgagaagctcaaagtgggcgacagggttgccgtgatgatgcggccgccctcaccacctcagactaaggcggtggtcgacccagctatctacgttaagatttccgattactacctggtgccaaacggcaaggggatgatcaaggtccctaatgacggcattccgcccgagaaggcccagtacctcctgtctgtgaactcataccccgttaagctcgtgagggaggtcgatgagaagctcagctacctggctggggtcatcctgggcgacgggtacatttccagcaatggctactacatctcggcgaccttcgacgatgaggcgtacatggacgctttcgtctccgttgtgagcgatttcatcccaaactacgtgccttccattaggaagaatggggactacacaatcgtcactgttggctctaagattttcgccgagatgctctcacggatcttcggcattccgcgcgggaggaagtccatgtgggacatccccgatgtcgttctcagcaacgacgatctgatgcgctacttcatcgccggcctcttcgacgcggatggctacgtggacgagaatggcccgagcatcgtgctggtcaccaagtcggagacggtcgccaggaagatctggtatgtgctccagcggctgggcatcatttcgacggtttctcgggtgaagtcgcgcggcttcaaggagggggagctcttccgggttatcatttctggcgtggaggatctcgctaagttcgccaagttcatcccactgaggcactcccggaagcgcgctaagctcatggagatcctgcgcacaaagaagccttacaggggcaggcgcacttacagggtcccaatctcgtctgacatgattgctccactgaggcagatgctcgggctgaccgtggctgagctctcaaagctggcctcctactacgcgggcgagaaggtcagcgagtcgctcatccgccatattgagaaggggagggtgaaggagatcaggaggtcgacgctgaagggcatcgctctcgctctgcagcagattgctaaggatgtgggcaacgaggaggcttgggtcagggctaagaggctccagctgatcgctgagggcgacgtctactgggatgaggtggtcagcgtcgaggaggttgacccgaaggagctgggcatcgagtatgtgtacgatctcacagtggaggatgatcataactacgttgctaatggcattctcgtttctaattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 577 - DNA, 2394 bp, Artificial Sequence
  Synthetic construct intein-modified proSavinase_S317:Pho_IF2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctgctgccggaggagcgggttattctgcctgactacgggcctattactctggaggagctcttcaatatgacaaaggagacagtgttcaaggacgaggagaaggaggtccggaagctcggcatccgcatgccagtggctggcgtcgatgggcgggtgcgcctgctggagggcccctacgtttggaaggtgcgctacaaggggaagatgctcagggtcaagctgaaggactggcacagcgtggctgtcacaccagagcatcccttcctcaccacgcggggctgggtgcgcgctgaccagctgaagcccggggattacgttgccgtgccaaagatcctccctgggaaggacgataaggagaagttcctccagtatgtgcacgagaagctgaagggcaaggttcatattaagctgccgtccagcgacgaggagtgggagacattcttctacttcgccggcactatcttcgggcgcgagaactcggtgaatccagagggcctcacccacgaggtcaaggctctcctggagctcttcaaggttctgttcgagtacccgagggaggtcctccgggttctgttcatggccccggtgcgctacgtggcgaacttcctccgcggcttcttcgacattaacggctacgtcaatggggaggagctgagggtcgaggttaggggggctccacatgaggttctggaggagctctccctgatcctcctgaggctgggcatcgtgtccaagatctaccctacgagcctggctatttcgggcaggaggaacctggagctgttccggcgctacatcgggttctcggagaagcagaaggccaaggagctggagggcatcattaggcggtctgagaactcagagtcctacccaattttcgaggagctgcgcaggatcaggctcctgttcggcttcacccgggcggagctctcgtctacgatcccactgtactctaagtacgagtcaaaggaggctccttcatacgagatcctcatgaagattctgaatacaatcgagaaggggtctaaggacctcaacaagaagatcactattctggagggcagggtgcgggatcacgagtacattgaggagttcaagcgcgagggcctgatcaaggacgggaagctcaccgagctgggcaaggagctcctggaggtctggcgcaacagggagttcgactccagggatgtcaactacctccggaatatcattgagaacttcgttttcctgccggtggagaagatcgaggagttcgagtacgatggctacgtctacgacgttactacagagactcataatttcattgctaatggcatcctcgttcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 578 - DNA, 2292 bp, Artificial Sequence
  Synthetic construct intein-modified proSavinase_S317:Pho_r-Gyr
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgttaccccagacacgctggtttcgctctcggacgggcggattattgagatcagggaggcggtggagaactcggaggagtcgctgctcgggatcaacggcctgaagccgaaggaggccaaggcgctcaagttctgggagatcgactgggatgggccgatcaaggtcatcaagctgaagaatggccacgagatcaaggctaccccagaccatgggctcctggttatgagggatgggaagatcggctgggtgtcggctaagaacattcgggagggcgactacgtcgccttcatctacaatctcgggcaccgcggcgggaagaagtacacgctcccccagctcctgaaggagctgggcatctccgagtacgagaactccagctcgcaggagctcaacaatcgcgagcaggagatggactccaagcagatcagcattgagctggatgagaggttctggtacatcttcggcgtgattctcggcaaggggaccctgaagggggacaaggtggtcatcttccagaaggatgtcaagccggttattgaggaggcgctgcccttcgtccggatcttcgagtcggctgaccacatcggcttctctcatctcattctggctgaggtcttccgcaggctcggcgttggggagggcaagctccactccctggtgttcggcctgagggaggagtacatcaacgctatgattgccgggtacttcgacgctagcggcaccttcctcaggagggctgtcctgacgagcaagcgcggcgatatcctcaggatgctgtcggtgtacctctaccagatcggcattgtcaacaatctgaggagggacgagcatgctggcgtgtgggagctcatcatttctgatctggagaagttccgcgagaagatctacccttacctcaggattaagaagtcacagttcgacaaggtctactctatttcaaagaacgagggcgatttcctcccggttgcgtctatcttccggaagctgaagttccgcgacggcttcaagaatcggatcctcgacgaggagattccacgcgatgaggtggcgaaggtcctggagtacgctgaggactcacctgagaaggagttcctcaactccctggttgaggccagggtgacatgggttcgggtggagaagatcgaggagaggcattacactggcaagctctacgacttcacaactactacagagaacttcatttccaatggcatcgtctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 579 - DNA, 2430 bp, Artificial Sequence
  Synthetic construct intein-modified proSavinase_S317:Pno_RPA2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctctctgcggatcatgaggttctcacatctacagggtggaaggctctccccgctattaaggatgcggatcaggttatgacgctggacctccagacgggcacacagcagtggaactcggtgcaggctaccacgaggttcgcgcgggagggctcactctacaggctgaagtccgacgatatggatgcggtctgcaacgagtctcaccgctggtacctcaatactaaggaccagccaacaacttacaccgctttcaccacgcagcagatgctggataaccagctcgtggctctgcgcaactcctccggcaaggctacggaccagtggaaccacgagtccgggacaactacccacacgaaccataatatccctacagtcggccataacgggaatgttatgttcagctggccagactgcccatggctcccacgcgagttcgtcgctgatgaggcgtgcaacctcgactggtgcaggttcatcggcctcgtgatgggcgacgggtcgattgatcatgtcacggacgctcagggccaggagcactacagcatccagattcatcagagggctgggaacccagcttcgaacgctaatacagaggatgtcctggagaggctggctgctaagctgccaaatttcgtggtccacccatcctgcgttagcggcgcggaggagaagcatacttggaccatcaaccaccgggacatgtaccatttcttcctccccatgatgcgcggcccacagtcctacgaccctctggataacgccatgtgcaggacctaccaggctccagattaccaggccctctcgcggtctgacaatgagcctatcattccagtgccagctgactggaagaccggcaactggtggcacctgcgcaggtggatcaattacccatggctcttctcgctggcccagtctcaggcgagggctatgattaagggcatggctgccgcgaacggggattggtcactctccctgaaggctaggctggacaccggcgattctggggttgtgagggttttcagcaattcgatccccctcatgcacgacatgtcagtgctgggcctcctggccgatactcgcgtgaacattggcgtcgaccataagaaggggcagatgcagctccaggtccctgttaccatgccggcgctcctggcttggtgcatctctttctcattcgcgaactccgacctggctgtggctgctccaaagcctgaggcgtacgataatccgaggcacgacggcttcgtttactgcctcacggtgcccaacgggaatttcctggcccggcgcacagtcgagtacagcgataatgataagattcaggaggtcattgatgctgctcagaagcctttcttcacaggcaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 580 - DNA, 2106 bp, Artificial Sequence
  Synthetic construct intein-modified proSavinase_S317:SaP-SETP3_Helicase
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctcaagcgggggacagaggtcattatgttcgatgggacaactaagaaggtggaggacgttatcgtgggggacgttctcatggggccagacagcacccctaggaacgtgctctcgctgggcagggggagggagatgatgtacgaggtgaagccacggaagggcgagtcctacacggtcaatgagtcacacatcctctccctgcgcaccacgacaggcattgcgaaggggtcctggcctgacaacacagtcttcgatatcagcgttcgggactggctcaagctgccaaagtatgtgactggccctaatgggtacctcaagggctggagggtgccagtcgatttcccaaggaaggagcaggacgaggctctcctgccaccatacctgatgggcctctggctgggcgacgggacttccagctcgggcgctatcacctcgggggagaatgagaaggagattagggcttacctggagtcttacgctgctaggaacggcatgcagatcaggaaggaggggctgacttggtctatttcacacggcaacaccgggcacaagaagcatggcttcacgcatgcgctcaagagcgctggggtgctgaacaataagcacatcccgcataactacaagtgcggcgataggaggcagaggctggagctcctggctggcctcctggactctgatgggtactgcgatctctcaaaggctggcttcgactggatttccgttagcgagaggctggccgacgatttctgctacctctgccggtcgctgggcttcgctgcctacaagaagaagacctgcaagcgctgcgcgaacacagacgtctggggcgattacttcagggtttcggtgtctggggacttctccgaggtgccattcgtcaggggcaggcatcagaatctccccaagcgcaacatcaataagaacgttctgaacgtgggcatcgagtccattacccccgtcggcgttgacgattacttcgggttcacaattgatggggattcaaggttcctcctcggggatttcacagttactcataatacctcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 581 - DNA, 2322 bp, Artificial Sequence
  Synthetic construct intein-modified proSavinase_S317:StP-Twort_ORF6
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcatttctatggactctatgattctgacaactgagggctacaagtcgctgcaggagattttcgagacacagggggttaaggtggacaacaaggagaaggttatcgagctgaagtacccgctcattaatcggtacggcgacgtggagtacacctcccacttcacgaagaacggggagaagccaacaaagcgcatcaagactaataagggcattgagctggttaacacatacaatcatcctctcctggtgagggaggggttcaacctgatctggaagaagagcgaggacatcgaagtgggcgatattctcgtgtcccgcgtgggcgaccaccagttcgggaacaataacactgtggagaacgaggaggaggcttacgctctgggctgcatggtcgcggattcttacctggggtcatactcccggctcagcttctcgaacgacaagaaggagatcctcgataaggtctcaaagttctggaacaccttctccaataaggaggtttactacgacacctacaaggagtccaaggggatcacgattcacctgcatgacacaaacaagactaaggagttccatgataagtacaagatcgagtacggcgtcgctaaggacaagaagatcccgaagtgcattatggagagccccgagaacatccagctggccttcgtctcgggctacctggagtgcgagtccagcatctctgagaagaacctggaggttacctctgcttcaaaggacctcctgaaggatctccagctgatcctctcgaacatcggcattgtgtctacgaataaggagaaggtggtcaagaagtacaagcacaacaagtactaccggctgatcgtcaatcgcaaggagctcattaagctcctgccgctcctgaggttcgagacgcagcagcggaagaaccagaaggagaatttcctcagcaataacacaaagatcaagtcgtcttacggcaacactattgaggggtcacgctacctcctgaagaagtacagggactccctgaatatcgataagaaggagttctccaagtacctcagccgggacaccatcacgattgatcgcctgagggaggtcatctcgctctacccggacggcgataaggagattcgcgagctgttcgagaacgttgtgaataacaatatctactaccagaaggtggagcaggtcctggagggcgagatcattcccaccttcgacgtttgcatgcctaagactcattccttcatcgccaacacaatcgtcaaccacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 582 - DNA, 2346 bp, Artificial Sequence
  Synthetic construct intein-modified proSavinase_S317:Ter_DnaE-2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctctcggggtctacaaaggtcattgacgctgctacggggaatctcttctcgctcaaggagatcgccgctcagcctgagtactggctctcgcgcaaggtcttctctctcgacctgaagtcacagcaggtggtccagcagccaatcaccgagattcaccctaatggcgtgagggatgtctggcagatcaccacgaggaccaacaggaaggtgtgcgctacggacgatcatctcttctacacagtcctgggctggaagccgctcaaggacttcagcgttggcgatcgcctcgggctgccgaataagatccccattaactacaggtcccagatctccgacagcaaggtgaagttcacggcgtacctcattggcgaggggtacctgtacacaaattcgttctcttgctcatacttctgcaactccgacggggagctcatcgcggatttctacggctgcgctgaggagctgttcgggtccagcgctccaatcgagaagcagctccacctgggcaataagtccgtgatctacgtgcggatcggcctcatttccgggctgaagaactgggtcgactcctacctccagtgcgcgaatagccgcgtgcaggagatccccaactggattttctccctcagccagtcgcagctccagctgttcctcggcatcctgtggtctacgtcagggatcttcgacgagacaattggctacacttactactcgtctaacagcgaggtcctggttaggcaggtccagcatctgttcctccggctgggcatcgtttccctcttcaacgtcaataaggttaagggccagggggagctggacgtgtcctacgttgtggaggtccgcgggagggaggatatgctgaagttctacaagctcatcaagccgtacctgtcatcctacaagcagggcctctgcgagagctgctacctggtcattaagtaccagcagtcgtaccagttcaagtacttcctcactcccgacttcttcgatctgatcgtgaaggctaagaaggccagctcgatgaccagggctctcggcgtttgcggcggggagatctcttcagtgtggaacttccagaatacatctaaccggtccctgagcttcgacaagttcaacaatttctcgactgtcctcgcggatgaggagctgaccgccatcgcgaactcggacgtgttctgggatgagatcatttctatcgagtacattggcaaggaggaggtgttcgatctcactattccagagactcataacttcattgctaatgacttcatcgtgcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 583 - DNA, 2031 bp, Artificial Sequence
  Synthetic construct intein-modified proSavinase_S317:Ter_RIR1-3
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggatacgctgctgattacaagggactctattcataagattaaggatgtcgtggggcagaagattgagatttggaatggcaagaactggtctcaggtcatcccgctgaagacagggaaggacaggaagctctaccgggttcgcttcggcgacgggtcgtacctggatgttaccgagtaccaccgcttcttcgtgaaggacaggttcggcaagaagtacgaggaggtgcagaccaaggatctcctgacgcactccaagtacgccctggacgtcgagccattcatcattgattaccatgacggcgattcgatcaacctctcttacgcttacacactgggggctgctctcggcaatgggactatcgaccagaactctaatggcaagattagggtgtactcacataaggccgagctgatcttcgcgggcaacaagtccctggagcggcagtacaattacctcccgagcttcgtggacgtcattgatctcggcttctcgggggagctcctgaggaggctgcagaccgagcccgacgctctcaacacgatcgcctcatggaataagtccgctatcctggccttcattgcgggcctcgctgacacagatgggagcgagactaagggcaacgggatcaagatttccgtgagcgactacgagagggccaagcggctgcagctcctgctcacgaagtgcggcattagggcgagcgtcaatctgatggcttcgcggggctgcaccacgaacctcggggagcgcaatcaggacctgtactacctccagatcaccgattgccgggagattccatgccagcgcctcgacacaactaaggtttgcgaggcgaagttccagggcaagtaccagaccatccagaacgtcgaggagctgcctggcctccacgatacgtactgcttcgaggagccagagttccacaagggggttttcggcaatgctctcacaggcaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 584 - DNA, 2271 bp, Artificial Sequence
  Synthetic construct intein-modified proSavinase_S317:Tko_Helicase
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcatgcatcctgacacatacgtggttactaagtcgggggctaagaaggtctctgagctgactgagggggatgaggtcctgacacataccggcacgttcaagaaggtcatccagccactgaggagggagcacaaggggcgcctcctggttatcaaggcctacggcaccgtgcctgtcaagattacgccggagcacatggtttgggtggtcaagcagatcaggcacaagtcccattacagcgatgggcggcaggtcatttggtgggagttcgagggcccagagtggatgacggctcaggagctgaaggagcgcctggagtccgagacagacccaaaggtgagctacatgctcctgcagccaatccctgagccgtccgtggacgcggataagattcctctgaggaaggaggtctacgttgtgaaccagcacggcaagacagacaagctccatccgtccgtgaagcggactcccgagtacctgccactcaacttcgagaccgctaggctgatcggcctctggattgctgaggggtcaacttccaagaacggcgtcatcaagttcgacatttccagcaatgaggaggatctgacggagttcatcacaggcactattaggaagtacttcccgcacgctaagatcgtcgttaaggaccatgagaggaacaggaggacggtccggttctgcaataagcgcttcgcggagtggctcagggagaacatcggccacggggctgataataagagcattccgcccctcctgctcctgaacaagaatagggaggtgcgcctgggcctcctgagggggctcatcgagggcgacggctacgtgcgcagggagtcgcagcgcagggcgaactacatcagctactcgacagtttctccctcactggcttaccagctccagctcctggtggcttcgctgggctacacctcgtctatccacaggtctattcggacagagggcatcgggaagactaggaagcccatctacgatgttaaggtgtcgggcaagtcttactactcactcctggaggagctcgggttcgaggtcccacagaggggcaacaggacctacaacgttaatcgcacgtggaagaattacctcctgctcaaggtgaggtccatcgaggaggaggagtacgagggcgacgtttacaatctggaggttgagggggatgagtcaggctctgtgggcttcatcgtgcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 585 - DNA, 2670 bp, Artificial Sequence
  Synthetic construct intein-modified proSavinase_S317:Tko_Pol-2_Pko_Pol-2
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttctattctgcctgaggagtggctgcctgttctggaggagggggaggttcatttcgttaggatcggggagctgattgaccgcatgatggaggagaacgctggcaaggtcaagagggagggggagaccgaggtcctggaggtttcaggcctggaggtgccgtccttcaaccgcaggacgaataaggcggagctgaagagggtcaaggctctcatccggcacgactactctggcaaggtgtacaccattaggctgaagtcaggccggcgcatcaagattacgtcagggcattccctgttcagcgtccggaacggcgagctcgttgaggtgaccggcgacgagctgaagccaggggatctcgtcgctgttccaaggaggctggagctgccagagaggaaccacgtcctcaatctggttgagctcctgctcggcacaccggaggaggagactctggacatcgtgatgacgattcccgtcaagggcaagaagaacttcttcaaggggatgctcaggacactgcggtggatcttcggcgaggagaagaggccaaggactgctcgcaggtacctcaggcatctggaggacctcggctacgtgcggctcaagaagatcgggtacgaggtcctggactgggatagcctcaagaattaccggcgcctgtacgaggctctcgtggagaacgtccgctacaacggcaataagagggagtacctggttgagttcaattcgatccgcgacgccgtggggattatgccgctgaaggagctcaaggagtggaagatcggcacactcaacgggttccggatgcgcaagctgattgaggtcgatgagtccctcgccaagctgctcggctactacgtgagcgaggggtacgcgcgcaagcagaggaacccgaagaatggctggtcgtactctgtcaagctgtacaatgaggaccccgaggttctggacgatatggagcggctcgcgagccgcttcttcggcaaggttaggcgggggaggaactacgtggagatccccaagaagattggctacctgctcttcgagaatatgtgcggggtgctcgctgagaacaagcgcatcccagagttcgtcttcacatcacctaagggcgttaggctggccttcctggaggggtactccagcgctatggctacctccacggagcaggagactcaggcgctgaacgagaagcgcgctctggccaatcagctcgttctgctcctgaactcggtgggcgtctctgctgtgaagctcggccacgactccggggtttacagggtgtacatcaatgaggagctgccattcgtcaagctcgataagaagaagaacgcttactacagccatgtgattcctaaggaggtcctctcggaggtcttcggcaaggttttccagaagaacgtgtccccacagaccttccggaagatggtcgaggacggcaggctggatcctgagaaggctcagaggctgtcgtggctcatcgagggggacgtggtcctcgatcgcgtcgagtctgttgacgtggaggactacgatggctacgtgtacgatctctctgtggaggataatgagaacttcctcgtgggcttcgggctcgtttacgctcataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 586 - DNA, 1983 bp, Artificial Sequence
  Synthetic construct intein-modified proSavinase_S317:Unc-ERS_RIR1
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgttaccgctgacacatgggttactaccgctgaggggccaaggcaggtggaggagctgatcggcaagaagttcacggctatcgttaacggcgaggagtgggagtccagcgaggaggggttcttcgagacagacgttaagccagtgtacaccctgaagacggctgagggcttcgagctgaggctcacggctgatcaccctgtcatgaaggttgagaggatgacacggtacaaggtggagactcagtggtccaacgctggcgacctcaagccaggggataagatcattatcaacaatcatagggacttcggcaattggagcgtcaaggggaagtacaccgagggcgaggggtacctgattggcctcctgctcggcgacgggacgatcaagaagctcaacccctggatgaaggcgatttcaaagaagatggagaaggcctccgcggatttctgcgagggcatcctgagggggctcttcgacgctgatggctctgtgcaggggaatcagtcgaagggcgtctctattcgcctggcccagtcagacgtcgagatcctcaaggcggttcagcgcattctgctcaggttcggcatcttctcgaaggtgtacatgaaccgcaggggcgagcggaaggttaagatgccggatgggaagggcggggtcaaggagtacatcaccaagccccagcacgagctcgtgatcagcaacgacaatatcctctacttcgctgagagggtcggcttctcggatgccgagaagatggagaagctggagaaggctatctggaactacaagcggaagatgaatagggagaggttcgtggctagcgtcgaggaggtggtcccagacggcgttgagaaggtgtacgacgttaagattccaggcatcaatgctttcaatgctaatggcttcgtggttcacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 587 - DNA, 1158 bp, Artificial Sequence
  Synthetic construct NI-GG-6H
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgtctggacctgaaaacgcaagtgcaaaccccgcaaggcatgaaggaaatctcaaacatccaagtcggtgacctggtgctgtcgaataccggctataacgaagtgctgaatgtttttccgaagagcaaaaagaaatcttacaagatcacgctggaagatggcaaggaaattatttgcagcgaagaacatctgttcccgacccagacgggcgaaatgaatatctccggcggtctgaaagaaggcatgtgtctgtacgtcaaggaaggtggccatcaccatcatcaccac

SEQ ID NO: 588 - DNA, 624 bp, Artificial Sequence
  Synthetic construct IC-SUMO-6H
atgatgctgaagaaaattctgaagatcgaagaactggatgaacgtgaactgattgacatcgaagttagcggcaaccatctgttttacgcgaatgacattctgacccacaactcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgtatggggtccctgcaggactcagaagtcaatcaagaagctaagccagaggtcaagccagaagtcaagcctgagactcacatcaatttaaaggtgtccgatggatcttcagagatcttcttcaagatcaaaaagaccactcctttaagaaggctgatggaagcgttcgctaaaagacagggtaaggaaatggactccttaacgttcttgtacgacggtattgaaattcaagctgatcagacccctgaagatttggacatggaggataacgatattattgaggctcaccgcgaacagattggaggtcatcaccaccatcatcac

SEQ ID NO: 589 - DNA, 627 bp, Artificial Sequence
  Synthetic construct S135_IMPDH-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttgctttgtcccgggcacgctggtgaataccgaaaatggtctgaaaaagattgaagaaattaaagtgggcgataaggtgtttagtcataccggcaaactgcaagaagtggttgatacgctgatttttgatcgtgacgaagaaattatcagtattaacggtatcgactgcaccaagaaccatgaattttacgtgatcgataaggaaaacgcgaatcgtgttaacgaagacaatatccatctgttcgcgcgctgggtccacgccgaagaactggatatgaaaaagcacctgctgatcgaactggaa

SEQ ID NO: 590 - DNA, 1029 bp, Artificial Sequence
  Synthetic construct S269_IMPDH-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgctttgtcccgggcacgctggtgaataccgaaaatggtctgaaaaagattgaagaaattaaagtgggcgataaggtgtttagtcataccggcaaactgcaagaagtggttgatacgctgatttttgatcgtgacgaagaaattatcagtattaacggtatcgactgcaccaagaaccatgaattttacgtgatcgataaggaaaacgcgaatcgtgttaacgaagacaatatccatctgttcgcgcgctgggtccacgccgaagaactggatatgaaaaagcacctgctgatcgaactggaa

SEQ ID NO: 591 - DNA, 1101 bp, Artificial Sequence
  Synthetic construct S293_IMPDH-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgctttgtcccgggcacgctggtgaataccgaaaatggtctgaaaaagattgaagaaattaaagtgggcgataaggtgtttagtcataccggcaaactgcaagaagtggttgatacgctgatttttgatcgtgacgaagaaattatcagtattaacggtatcgactgcaccaagaaccatgaattttacgtgatcgataaggaaaacgcgaatcgtgttaacgaagacaatatccatctgttcgcgcgctgggtccacgccgaagaactggatatgaaaaagcacctgctgatcgaactggaa

SEQ ID NO: 592 - DNA, 1173 bp, Artificial Sequence
  Synthetic construct S317_IMPDH-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgctttgtcccgggcacgctggtgaataccgaaaatggtctgaaaaagattgaagaaattaaagtgggcgataaggtgtttagtcataccggcaaactgcaagaagtggttgatacgctgatttttgatcgtgacgaagaaattatcagtattaacggtatcgactgcaccaagaaccatgaattttacgtgatcgataaggaaaacgcgaatcgtgttaacgaagacaatatccatctgttcgcgcgctgggtccacgccgaagaactggatatgaaaaagcacctgctgatcgaactggaa

SEQ ID NO: 593 - DNA, 1176 bp, Artificial Sequence
  Synthetic construct T318_IMPDH-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcatgctttgtcccgggcacgctggtgaataccgaaaatggtctgaaaaagattgaagaaattaaagtgggcgataaggtgtttagtcataccggcaaactgcaagaagtggttgatacgctgatttttgatcgtgacgaagaaattatcagtattaacggtatcgactgcaccaagaaccatgaattttacgtgatcgataaggaaaacgcgaatcgtgttaacgaagacaatatccatctgttcgcgcgctgggtccacgccgaagaactggatatgaaaaagcacctgctgatcgaactggaa

SEQ ID NO: 594 - DNA, 588 bp, Artificial Sequence
  Synthetic construct S135_gp41-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttgtctggacctgaaaacgcaagtgcaaaccccgcaaggcatgaaggaaatctcaaacatccaagtcggtgacctggtgctgtcgaataccggctataacgaagtgctgaatgtttttccgaagagcaaaaagaaatcttacaagatcacgctggaagatggcaaggaaattatttgcagcgaagaacatctgttcccgacccagacgggcgaaatgaatatctccggcggtctgaaagaaggcatgtgtctgtacgtcaaggaa

SEQ ID NO: 595 - DNA, 990 bp, Artificial Sequence
  Synthetic construct S269_gp41-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgtctggacctgaaaacgcaagtgcaaaccccgcaaggcatgaaggaaatctcaaacatccaagtcggtgacctggtgctgtcgaataccggctataacgaagtgctgaatgtttttccgaagagcaaaaagaaatcttacaagatcacgctggaagatggcaaggaaattatttgcagcgaagaacatctgttcccgacccagacgggcgaaatgaatatctccggcggtctgaaagaaggcatgtgtctgtacgtcaaggaa

SEQ ID NO: 596 - DNA, 1062 bp, Artificial Sequence
  Synthetic construct S293_gp41-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgtctggacctgaaaacgcaagtgcaaaccccgcaaggcatgaaggaaatctcaaacatccaagtcggtgacctggtgctgtcgaataccggctataacgaagtgctgaatgtttttccgaagagcaaaaagaaatcttacaagatcacgctggaagatggcaaggaaattatttgcagcgaagaacatctgttcccgacccagacgggcgaaatgaatatctccggcggtctgaaagaaggcatgtgtctgtacgtcaaggaa

SEQ ID NO: 597 - DNA, 1134 bp, Artificial Sequence
  Synthetic construct S317_gp41-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgtctggacctgaaaacgcaagtgcaaaccccgcaaggcatgaaggaaatctcaaacatccaagtcggtgacctggtgctgtcgaataccggctataacgaagtgctgaatgtttttccgaagagcaaaaagaaatcttacaagatcacgctggaagatggcaaggaaattatttgcagcgaagaacatctgttcccgacccagacgggcgaaatgaatatctccggcggtctgaaagaaggcatgtgtctgtacgtcaaggaa

SEQ ID NO: 598 - DNA, 1137 bp, Artificial Sequence
  Synthetic construct T318_gp41-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcatgtctggacctgaaaacgcaagtgcaaaccccgcaaggcatgaaggaaatctcaaacatccaagtcggtgacctggtgctgtcgaataccggctataacgaagtgctgaatgtttttccgaagagcaaaaagaaatcttacaagatcacgctggaagatggcaaggaaattatttgcagcgaagaacatctgttcccgacccagacgggcgaaatgaatatctccggcggtctgaaagaaggcatgtgtctgtacgtcaaggaa

SEQ ID NO: 599 - DNA, 597 bp, Artificial Sequence
  Synthetic construct S135_gp41-8-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttgtctgtccctggatacgatggttgtgacgaatggcaaggctattgaaatccgtgatgtgaaagtgggcgactggctggaaagcgaactgggcccggtgcaggttaccgaagtcctgccgattatcaaacaaccggtttttgaaattgtcctgaaaagcaagtctggcaaaaagatccgtgtgagcgcaaaccataaattcccgaccaaggatggtctgaaaacgattaatagtggcctgaaggttggtgactttctgcgttcccgcgcgaaa

SEQ ID NO: 600 - DNA, 999 bp, Artificial Sequence
  Synthetic construct S269_gp41-8-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgtctgtccctggatacgatggttgtgacgaatggcaaggctattgaaatccgtgatgtgaaagtgggcgactggctggaaagcgaactgggcccggtgcaggttaccgaagtcctgccgattatcaaacaaccggtttttgaaattgtcctgaaaagcaagtctggcaaaaagatccgtgtgagcgcaaaccataaattcccgaccaaggatggtctgaaaacgattaatagtggcctgaaggttggtgactttctgcgttcccgcgcgaaa

SEQ ID NO: 601 - DNA, 1071 bp, Artificial Sequence
  Synthetic construct S293_gp41-8-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgtctgtccctggatacgatggttgtgacgaatggcaaggctattgaaatccgtgatgtgaaagtgggcgactggctggaaagcgaactgggcccggtgcaggttaccgaagtcctgccgattatcaaacaaccggtttttgaaattgtcctgaaaagcaagtctggcaaaaagatccgtgtgagcgcaaaccataaattcccgaccaaggatggtctgaaaacgattaatagtggcctgaaggttggtgactttctgcgttcccgcgcgaaa

SEQ ID NO: 602 - DNA, 1143 bp, Artificial Sequence
  Synthetic construct S317_gp41-8-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgtctgtccctggatacgatggttgtgacgaatggcaaggctattgaaatccgtgatgtgaaagtgggcgactggctggaaagcgaactgggcccggtgcaggttaccgaagtcctgccgattatcaaacaaccggtttttgaaattgtcctgaaaagcaagtctggcaaaaagatccgtgtgagcgcaaaccataaattcccgaccaaggatggtctgaaaacgattaatagtggcctgaaggttggtgactttctgcgttcccgcgcgaaa

SEQ ID NO: 603 - DNA, 1146 bp, Artificial Sequence
  Synthetic construct T318_gp41-8-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcatgtctgtccctggatacgatggttgtgacgaatggcaaggctattgaaatccgtgatgtgaaagtgggcgactggctggaaagcgaactgggcccggtgcaggttaccgaagtcctgccgattatcaaacaaccggtttttgaaattgtcctgaaaagcaagtctggcaaaaagatccgtgtgagcgcaaaccataaattcccgaccaaggatggtctgaaaacgattaatagtggcctgaaggttggtgactttctgcgttcccgcgcgaaa

SEQ ID NO: 604 - DNA, 639 bp, Artificial Sequence
  Synthetic construct S135_NrdJ-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttgcctggtcggtagcagcgaaatcatcacgcgcaactatggtaaaacgacgatcaaggaagtggtggaaatctttgacaacgataaaaacattcaggtcctggcgtttaacacccatacggataatattgaatgggccccgatcaaagcggcccaactgacccgtccgaatgcagaactggttgaactggaaattgacacgctgcatggcgtcaaaaccatccgctgcacgccggatcacccggtctataccaagaaccgtggttacgtgcgcgctgacgaactgacggatgacgatgaactggtggttgcaatt

SEQ ID NO: 605 - DNA, 1041 bp, Artificial Sequence
  Synthetic construct S269_NrdJ-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgcctggtcggtagcagcgaaatcatcacgcgcaactatggtaaaacgacgatcaaggaagtggtggaaatctttgacaacgataaaaacattcaggtcctggcgtttaacacccatacggataatattgaatgggccccgatcaaagcggcccaactgacccgtccgaatgcagaactggttgaactggaaattgacacgctgcatggcgtcaaaaccatccgctgcacgccggatcacccggtctataccaagaaccgtggttacgtgcgcgctgacgaactgacggatgacgatgaactggtggttgcaatt

SEQ ID NO: 606 - DNA, 1113 bp, Artificial Sequence
  Synthetic construct S293_NrdJ-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgcctggtcggtagcagcgaaatcatcacgcgcaactatggtaaaacgacgatcaaggaagtggtggaaatctttgacaacgataaaaacattcaggtcctggcgtttaacacccatacggataatattgaatgggccccgatcaaagcggcccaactgacccgtccgaatgcagaactggttgaactggaaattgacacgctgcatggcgtcaaaaccatccgctgcacgccggatcacccggtctataccaagaaccgtggttacgtgcgcgctgacgaactgacggatgacgatgaactggtggttgcaatt

SEQ ID NO: 607 - DNA, 1185 bp, Artificial Sequence
  Synthetic construct S317_NrdJ-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctggtcggtagcagcgaaatcatcacgcgcaactatggtaaaacgacgatcaaggaagtggtggaaatctttgacaacgataaaaacattcaggtcctggcgtttaacacccatacggataatattgaatgggccccgatcaaagcggcccaactgacccgtccgaatgcagaactggttgaactggaaattgacacgctgcatggcgtcaaaaccatccgctgcacgccggatcacccggtctataccaagaaccgtggttacgtgcgcgctgacgaactgacggatgacgatgaactggtggttgcaatt

SEQ ID NO: 608 - DNA, 1188 bp, Artificial Sequence
  Synthetic construct T318_NrdJ-1-NI
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcatgcctggtcggtagcagcgaaatcatcacgcgcaactatggtaaaacgacgatcaaggaagtggtggaaatctttgacaacgataaaaacattcaggtcctggcgtttaacacccatacggataatattgaatgggccccgatcaaagcggcccaactgacccgtccgaatgcagaactggttgaactggaaattgacacgctgcatggcgtcaaaaccatccgctgcacgccggatcacccggtctataccaagaaccgtggttacgtgcgcgctgacgaactgacggatgacgatgaactggtggttgcaatt

SEQ ID NO: 609 - DNA, 858 bp, Artificial Sequence
  Synthetic construct S135_IMPDH-IC
atgaagttcaagctgaaggaaatcaccagcatcgaaacgaaacattataagggcaaagttcacgatctgaccgtcaaccaagaccattcttacaatgttcgcggtacggtcgtgcacaactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 610 - DNA, 456 bp, Artificial Sequence
  Synthetic construct S269_IMPDH-IC
atgaagttcaagctgaaggaaatcaccagcatcgaaacgaaacattataagggcaaagttcacgatctgaccgtcaaccaagaccattcttacaatgttcgcggtacggtcgtgcacaactcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 611 - DNA, 384 bp, Artificial Sequence
  Synthetic construct S293_IMPDH-IC
atgaagttcaagctgaaggaaatcaccagcatcgaaacgaaacattataagggcaaagttcacgatctgaccgtcaaccaagaccattcttacaatgttcgcggtacggtcgtgcacaacagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 612 - DNA, 312 bp, Artificial Sequence
  Synthetic construct S317_IMPDH-IC
atgaagttcaagctgaaggaaatcaccagcatcgaaacgaaacattataagggcaaagttcacgatctgaccgtcaaccaagaccattcttacaatgttcgcggtacggtcgtgcacaactcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 613 - DNA, 309 bp, Artificial Sequence
  Synthetic construct T318_IMPDH-IC
atgaagttcaagctgaaggaaatcaccagcatcgaaacgaaacattataagggcaaagttcacgatctgaccgtcaaccaagaccattcttacaatgttcgcggtacggtcgtgcacaacacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 614 - DNA, 849 bp, Artificial Sequence
  Synthetic construct S135_gp41-1-IC
atgatgctgaagaaaattctgaagatcgaagaactggatgaacgtgaactgattgacatcgaagttagcggcaaccatctgttttacgcgaatgacattctgacccacaactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 615 - DNA, 447 bp, Artificial Sequence
  Synthetic construct S269_gp41-1-IC
atgatgctgaagaaaattctgaagatcgaagaactggatgaacgtgaactgattgacatcgaagttagcggcaaccatctgttttacgcgaatgacattctgacccacaactcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 616 - DNA, 375 bp, Artificial Sequence
  Synthetic construct S293_gp41-1-IC
atgatgctgaagaaaattctgaagatcgaagaactggatgaacgtgaactgattgacatcgaagttagcggcaaccatctgttttacgcgaatgacattctgacccacaacagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 617 - DNA, 303 bp, Artificial Sequence
  Synthetic construct S317_gp41-1-IC
atgatgctgaagaaaattctgaagatcgaagaactggatgaacgtgaactgattgacatcgaagttagcggcaaccatctgttttacgcgaatgacattctgacccacaactcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 618 - DNA, 300 bp, Artificial Sequence
  Synthetic construct T318_gp41-1-IC
atgatgctgaagaaaattctgaagatcgaagaactggatgaacgtgaactgattgacatcgaagttagcggcaaccatctgttttacgcgaatgacattctgacccacaacacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 619 - DNA, 873 bp, Artificial Sequence
  Synthetic construct S135_gp41-8-IC
atgtgcgaaattttcgaaaacgaaatcgattgggacgaaattgccagcatcgaatatgtcggcgtggaagaaaccattgatatcaacgttacgaatgaccgcctgtttttcgcgaacggtatcctgacgcacaattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 620 - DNA, 471 bp, Artificial Sequence
  Synthetic construct S269_gp41-8-IC
atgtgcgaaattttcgaaaacgaaatcgattgggacgaaattgccagcatcgaatatgtcggcgtggaagaaaccattgatatcaacgttacgaatgaccgcctgtttttcgcgaacggtatcctgacgcacaattcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 621 - DNA, 399 bp, Artificial Sequence
  Synthetic construct S293_gp41-8-IC
atgtgcgaaattttcgaaaacgaaatcgattgggacgaaattgccagcatcgaatatgtcggcgtggaagaaaccattgatatcaacgttacgaatgaccgcctgtttttcgcgaacggtatcctgacgcacaatagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 622 - DNA, 327 bp, Artificial Sequence
  Synthetic construct S317_gp41-8-IC
atgtgcgaaattttcgaaaacgaaatcgattgggacgaaattgccagcatcgaatatgtcggcgtggaagaaaccattgatatcaacgttacgaatgaccgcctgtttttcgcgaacggtatcctgacgcacaattcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 623 - DNA, 324 bp, Artificial Sequence
  Synthetic construct T318_gp41-8-IC
atgtgcgaaattttcgaaaacgaaatcgattgggacgaaattgccagcatcgaatatgtcggcgtggaagaaaccattgatatcaacgttacgaatgaccgcctgtttttcgcgaacggtatcctgacgcacaatacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 624 - DNA, 858 bp, Artificial Sequence
  Synthetic construct S135_NrdJ-1-IC
atggaagctaaaacctatatcggcaaactgaagagccgtaagattgtgtctaacgaagacacctacgatatccagaccagtacgcataactttttcgcaaatgatatcctggttcacaattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 625 - DNA, 456 bp, Artificial Sequence
  Synthetic construct S269_NrdJ-1-IC
atggaagctaaaacctatatcggcaaactgaagagccgtaagattgtgtctaacgaagacacctacgatatccagaccagtacgcataactttttcgcaaatgatatcctggttcacaattcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 626 - DNA, 384 bp, Artificial Sequence
  Synthetic construct S293_NrdJ-1-IC
atggaagctaaaacctatatcggcaaactgaagagccgtaagattgtgtctaacgaagacacctacgatatccagaccagtacgcataactttttcgcaaatgatatcctggttcacaatagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 627 - DNA, 312 bp, Artificial Sequence
  Synthetic construct S317_NrdJ-1-IC
atggaagctaaaacctatatcggcaaactgaagagccgtaagattgtgtctaacgaagacacctacgatatccagaccagtacgcataactttttcgcaaatgatatcctggttcacaattcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 628 - DNA, 309 bp, Artificial Sequence
  Synthetic construct T318_NrdJ-1-IC
atggaagctaaaacctatatcggcaaactgaagagccgtaagattgtgtctaacgaagacacctacgatatccagaccagtacgcataactttttcgcaaatgatatcctggttcacaatacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 629 - DNA, 7148 bp, Artificial Sequence
  Synthetic construct pET22_iSAV_Hwa_S317_nuc
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatatacatatgaaatacctgctgccgaccgctgctgctggtctgctgctcctcgctgcccagccggcgatggccatggatatcggaattaattcggatccatggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgattgcctcacaactgacaggatcaccgctgtgaagaccgtcacgccaacagctgagtgggtctacgatctggaggtggagggcacacacgcctacctcacaaacggggttctctcacacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgtctcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 630 - DNA, 5541 bp, Artificial Sequence
  Synthetic construct p416GALL-Ura
gacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctcggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaatgaacgaatcaaattaacaaccataggatgataatgcgattagttttttagccttatttctggggtaattaatcagcgaagcgatgatttttgatctattaacagatatataaatgcaaaaactgcataaccactttaactaatactttcaacattttcggtttgtattacttcttattcaaatgtaataaaagtatcaacaaaaaattgttaatatacctctatactttaacgtcaaggagaaaaaaccccggattctagaactagtggatcccccgggctgcaggaattcgatatcaagcttatcgataccgtcgacctcgagtcatgtaattagttatgtcacgcttacattcacgccctccccccacatccgctctaaccgaaaaggaaggagttagacaacctgaagtctaggtccctatttatttttttatagttatgttagtattaagaacgttatttatatttcaaatttttcttttttttctgtacagacgcgtgtacgcatgtaacattatactgaaaaccttgcttgagaaggttttgggacgctcgaaggctttaatttgcggccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 631 - DNA, 1143 bp, Artificial Sequence
  Synthetic construct Savinase_BamHIsite_S135
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggatccggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 632 - DNA, 1143 bp, Artificial Sequence
  Synthetic construct Savinase_BamHIsite_S317
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggatccacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 633 - DNA, 2064 bp, Artificial Sequence
  Synthetic construct intein-modified proSavinase_S317:Unc-ERS_RIR1_var7
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcgttaccgctgacacatgggttactaccgctgaggggccaaggcaggtggaggagttgatcggcaagaagttcacggctatcgttaacggcgaggagtgggagtccagcgaggaggggttcttcgagacagacgttaagccagtgtacaccctgaagacggctgagggcttcgagctgaggctcacggctgatcaccctgtcatgaaggttgagaggatgacacggtacaaggtggagactcagtggtccaacgctggcgacctcaagccaggggataagatcattatcaacaatcatagggacttcggcaattggagcgtcaaggggaagtacaccgagggcgaggggtacctgattggcctcctgctcggcgacgggacgatcaagaagctcaacccctggatgaaggcgatttcaaagaagatggagaaggcctccgcagatttctgcgagggcatcctgagggggctctccgacgctgatggctctgtgcaggggaatcagtcgaagggcgtctctattcgcctggcccagtcagacgtcgagatcctcaaggcggttcagcgcattctgctcaggttcggcatcttctcgaaggtgtacatgaaccgcaggggcgagcggaaggttaagatgccggatgggaagggcggggtcaaggagtacatcaccaagccccagcacgagctcgtgatcagcaacgacaatatcctctacttcgctgagagggtcggcttctcggatgccgagaagatggagaagctggagaaggctatctggaactacaagcggaagatgaatagggagaggttcgtggctagcgtcgaggaggtggtcccagacggcgttgagaaggtgtacgacgttaagattccaggcatcaatgctttcaatgctaatggcttcgtggttcacaactcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 634 - DNA, 405 bp, Artificial Sequence
  Synthetic construct Cth_ATPase_BIL codon optimized
tgcttcgtggcgggcactatgatcctgacagtcgcggggctggtcgctattgagaatattaaggcgggggacaaggtcatcgctactaacccggagacattcgaggtggctgagaagaccgtcctggagacctacgtgcgcgagaccacggagctcctgcacctgacgatcaatggcgacgtcattaagacaactttcgagcatctcttctacgccaaggatgtcgggttcgttgaggcgaaggagctgcaggtcggcgacaagctcctggattccaaggggaacgtgctcgtggtcgaggacaagaagatcaagattaccgatgagcccgttaaggtgtacaatttccaggttgatgacttccacacataccacgttgggtgcaatggggttctcgttcataat

SEQ ID NO: 635 - DNA, 1041 bp, Artificial Sequence
  Synthetic construct Cwa_RIR1 codon optimized
tgcgtcgcgccggagacaaagatcctcacagacagggggcagatcgccatcgctgacgtcgcgggggagaaggtcaatatttggaacgggtcggagtggtctgaggttctcgtgaagaagacaggcgagaaccagccgctcctgaaggtgcacttctcaaatggcgagtccctggactgcacttactaccacaagttccatgtccaggagaactacaaggggaaggtcaagatcgttgaggctaaggacctccaggagggcgataagctgattaagtaccggctcccactggtggagtccgagaatgacatcgatttcccttacgcctacaccagcggcttcttctcgggcgacgggtctcatgatggcatggggaagccggagattgacctctacggcgagaagaaggagctcctgcccttcgtcacggttaggaacaagtactacggcgggtcatacggcgacaagtcctggcgcatcgagagggatgaggtggccgtctacgacgatgttaaccaggaccggatcgtgtgcaagctcccgctggatattcccgcgaagttcacagttcccgtgaatggctacactatccagagcaggctggagtggctggctggcctcctggacgcggatgggacagtcgctaggaacggcgacaatgagagcctgcaggttgcgtcgacccaccagcagttcctcctggacatccgcctcatgctgcagacgctcggcgtcgactctaaggtggtcaagatggatgagatggggtacaggtcgctgccagacggcaagggcgggtaccaggattacttctgccaggcgaagtaccgcctcctgatttccagcaacggcctcttccagctgggcgagctcgggctgaagaccaacaggctccagtggaatctgagggagcctcagagggaggcttcccagttcatcagggtggagaaggtcgagctcacctgccggtacgacgatacgtactgcttctcagagccaaagaggcatctcggcatgttcaatggcatcctcacagggcag

SEQ ID NO: 636 - DNA, 1821 bp, Artificial Sequence
  Synthetic construct Dhan_GLT1 codon optimized
tgcctcgcttcggacactctcgttcgcacatcggagggggacaagccagtcgctgaggtcgctatcggggactacctgctggacgctgaggacaagccagtcctctgcatgggcgctaacccttcccagaccgggcgcatgaaggagatcgcttaccaggacttcgattcgaagaagagggtgtctttcaagtgcacaccggaccaccacctggagctgacactcactgattccactccctccctcagcggcaagtcagtcacctggttctccaggtgcacgggggctcacctcagcgaggaggtgtcggaggtctacctggacaacatggtttcgatcttctacaatgatctggttgactcgacggattctgcggtggacaaggattccattcacgaggccgtggacctggcgctggaggatcactaccataggggcaactctgaccagtactcaatccatctcaatgagtacatcagccggattgccgataaggagctgcagaacgagccggagttcatccgggagtgcattcacgacgccgcgaatcgcttcgtcatcacctccagcggcaacaggaatattaagtcggagtctttcgacgataagctcctgctctcacgctccaggtcgtctacagctgacagcgattcggactacgtgatcactgacgcctccgtccactctcattcaaacaattcatccgtctacctcgcctcaccagactccatgatccctgatggcgctgccaaccgcttcgagaatattgcgtccaagctgaaggagccagtgtgcaactgcggcgggatccggaagattttccgcagcttcggcaccacggaggacgctgagctcgcttactccctgctcctgagcgagcactactacaggctggacccacggttcgtcacagatggctacactttccaggcctcggttgagcagtacgagaacatgtgctctcaggaggtgcagaatatgcacctgaagctctaccgctcacctctcaagttcgtggagagggagcataactccgctgagctgccagtcgacccatacttcctgggcctctggctgggcgatggggacagctcggggacaactatcatgaccacggatcgggagattgtggtctggctcaactcctacgtcgagcgcctgaaccagaataagccggagggctgcttccccctcaagctgaccgagcagctgatctacggcgctgggcacacgtccaagagcgggcatacaactaaggtcgacgttaggaattacaagatctcttcaggcgatgctttcgtgcggtcggggacatactggaacccgattttcgacggcctcaagaagctggggctcctgaacaataagagcgctggcatcccccaggagtacatgaactctgacgagcagaataggctctcagttattgccggcctgatggattccgacgggtgctacgtgaagagccacaacacctaccgcttcacccagctcacggaggaccataagaagatcgtctacgatctgaaggagctcgccctgagctgcggcattaacaccacgggggtcgagctctcggttaagccgctgggcttcaataagcacaagcattctaccgagtatgtggtgtacctcggcaacgggagccagaagttccaggagctcctgctcctgccacggaagaagatggagatcagcaagaagcacgtgtcgctggacgcgcgccctttcacggttagcgacgtggaggatggcgagttccgggctattgaggtttcagggggggttttccagctcgctaataggctcgtggttgctaat

SEQ ID NO: 637 - DNA, 882 bp, Artificial Sequence
  Synthetic construct Fsp-CcI3_RIR1 codon optimized
tgccagccatacgacgctctcgtttcaacgccatcggggctcgttcctatcggggctctcgtggagacagacgcggtcggcatgaaggtgttcgatgcgcacggcctcacacaggtcattgctactaagagcaacggggttaaggacgtgctgaggatctggacccgcgcgggccacgctctcgacgtcacggccgatcatctggtttggaggtccacaagcgctggcgctggggctttcgtgccagctggcgctctcagggctggggacacactggagtggcataggactattgctccaggcgagggggagatcacgagccgcgagattgctgaggctgctctcgctggcaggctgcaggctgatggcttcgtcgggcgctacgctgggaccaatgcttcgctcacgatcgaggcgatgaccgttccaacgaggctctacgacgctccactgccagtggtcgctgcctacctcaggtcactgttccaggctgatggctacgtctcgcgcagggagaggtctaccctcatcggcctggacatgatttccgaggggctgatcaggggcgttcaggggctcctggctaggttcggcatcttcgccagggtgcggagggaggctgatccacgccctgacaggcacgatctctggtccctgggcattcagaacgctggggacaggcggaccttcgccgatgagatcggcttcctcgacccagtgaaggcggctaagctggaggcttccttcgaccagccaggccaggctgctaagcctgtcaagaggctccagatcgagaggattgagccgaggggcccgatgcccgtctacgacattcagacagattccggggagtacctctctgctgggctcagggttcataac

SEQ ID NO: 638 - DNA, 861 bp, Artificial Sequence
  Synthetic construct Gob_Hyp codon optimized
tgccagcctgcggggacacaggtcgctaaggttattaaggaggggaggtggagggaggattcggttattgagcaggttcctattgagtcactccagccaggcgacagggtggtctccttcgggaacgcgaagatctaccgcaggggccgcgctgtgacagggattacttcccggcgccacacaggcaatctgcatagggtcgaggttggggagttccgcaccagggccacgccagagcacaggttcaccgtccggttcgacccagctaggcctaaggctggcctcctgtacctcatgaggaggggcgataggtggagggtgggcgtctgcgggatgttcaactcgcgcggcttcggggtttccgtgcggctgagccaggagaggggcgacgctgcttgggtgctcggggccttcgcgacactgactgaggctaggatcgccgagcaggttgtgagctgccggtacggcattccaaccacggtctgggagaccggcaggaatcctggggcttcgtgggctcagagggaccaggctggcatcgatgccatctaccagaggctcggcgtcgataggatccgggctggggttgacaggctcctgagggatcacggcctctctgctgggctgccactcctggctgccaacgagcccggcaatttctcgtgcaggcagtctaggcaggtggctgcttgcaacctggtgccaggcgtcatgcaggtcccagttccaacggctggcgagaggttcgagtggagggacctcaccgctacgagcttcgagagggttcatgatctggaggtgtggagcatggatgtggagagggataagcattacgttgcggatggcatcgttgtgcataac

SEQ ID NO: 639 - DNA, 1236 bp, Artificial Sequence
  Synthetic construct Gvi_RIR1-1 codon optimized
tgcttcgctgcggggacgctgctgcatactgagcagggctacgttccggtggagcaggtcgtggcgggggtcgggacaagggtttgcacacaccagggcttccggaacatctctgagcgcttcgataatggggaggccgaggttttcagggtgaccacgcggaagggctactccgtggaggtcactgcgaaccacaagatggctcgcctcgacgagaatggcgatctcctgctcgacgagctctcacatctgcaagtgggcgacaacctgctcctgctcctggggtccaatccggtgaccgagaaggtccggctgcagtgcatcccagctggctaccgctccagcatcgagattgctcagccgcccgagctcgatgagcagctggcttacctcctgggctacgcctacggcgacgggtgcgtcggcaggggggctacatacaactacctcagcctggctgtgtcgcacacttacccgaatgtccgcgaccagctcgccgcgatcattagggagaagttcggcctgacaactaagatctactcaggctccggggcggtttggaacctcctggtgcattccgccaatctcctggattggctcaaggcgaacggcctcctgaagcagaaggctgcggacctcgccatgccagaggcgattctgcgctcgccttcgtctgtggtcggcgctttcctgtctgggtacttcgacgctgatggctgcgtgaggggcgggaagggcgggtacgggttcgattgcacgagcaaggctttcgtcggcgctgttcagctcctgctcctggccgaggggatcgtgtccaacctccacaccacggaccggagccgccagggctggcgcacaatctacaggctcaatgtctgcggcaccgagttcaagcgcaggttccagacgctgtgctgcaggtctgcgaaggttgtgcattcaccaatggtgctcggcagggatgggaccggcgggtacccacctgctctggttaggggcgcttcgtaccagagggtcgttgctgtcggcgggaagcacctcctgtacacggcgctcctgaaggtcatcgagaagacaaggactgctggcaagcaggctctcgctgagagcctgtgccagcatgtcaactacttcccggaccccatcgtcgcgattgagtcggttggcacgcagagggtttacgatattgaggtggagggcatgcatctgctcggcaatggcatctacacaagcaac

SEQ ID NO: 640 - DNA, 1476 bp, Artificial Sequence
  Synthetic construct Hhal_DnaB-1 codon optimized
tgcctcgcctacgacgcggagatcgttcaggctgacgggggggttaagactattgagcagatcgttagggagcggcgggcgcatctcgctacggtcggcgctgactggaggctgacatggactgagccgtgcgattacgttgacgatggccacaagcccgtcttcgaggttaccacgcgcctcgggcgcaggatcgagacaactctgacacacccgttcctcactgtccatggctggcagaggctggaggacctcgctgagggcgatgctatcggggtcccaaggcagctgccagttttcggccaggagcccattagggactgcgaggtgaggctcctgggccacctgatcggggatggcgggctcaccggctcgccacccaggctgacgtctgggcaggaggcgatgacagctgacttcctggaggctgtggatgctttcggcggggtcgaggctaagccaatcagggcgtcccggaggacgcagagctgggtggtcgttggcgctgctcaggcccgcgctgctgctaggtccagcttcgcttcactggtcgacgccctcattaggaggtcccctctcaccggcagggctatcgctaggaacctgggggtggcgccagctaccctcacgtactggaggcagggcgtgaatgtccctgacgctgctatggttgggctcctggctggcgagctgggggttgatgtgggcgagctcaggccagagcctgtggctcgcaggaacgaccgcaatccactgcaggcttggctcgataggctgggcctcgctgggaagtccgctcacgagaagactgtgccagactgcgtcttccggctgcctcgcgagcagctcgctaggttcctgaaccggctcttctcgtctgacgggtgggtgacacatctggctagcggccaggggcagattggctacaccacggtctcggaggctctcgctaggcagatccagcacctcctgctccggttcggcgttctggctaagctcaggcataggtccgtgcgctaccaggacggcaggaggccagcctggcagctggatattactcacgcggagagcatcctcaccttcgctgagcagatcggcattctggggaaggagcagcggctcgcctctgttgctgcttcagtgcgcggcaggaggaggcagtcgcacacggaccatatcccctgcgagatttggcagttcatcgatagggccaggggcgagtggacatgggctgagctggctaggagggctggggtcgcttcatccaatatccacgcctacaggaggggcatgtctaggcagaggctggctgctttcgctgacgctctcggctcaagggagctgaggcagctcgcgagctcggacctgtactgggatcggatcgcctccattcgcccgctcggccataagcaggtgtacgatctcactattccagagactcataacttcattgctaatgatgtttgcgtgcataat

SEQ ID NO: 641 - DNA, 1431 bp, Artificial Sequence
  Synthetic construct Hma_CDC21 codon optimized
tgcgtgcatggggatacaagggttactctcgctgatgggcatgagcggcctattcgggaggtcgtggagtcaaatctggatgatccgaagccagtcgacgatggggtttgggataccgtggacttcgatgtcccttctctgcagtcagacggcacagttgcgactcagaacgctacgaaagtgtggaagcggaaggcgccggagacactctaccgcatcaggaccgctacgggcagggagctggatgtcacaccatcacaccctctcttcgttcagtccgacgggaggttccaggctaggaaggctgaggagctggagtctggcacccatgttgctgtgcccaggaaggtttcaactaacgcctgcaatgagctcgacgtcaccttccggcagtctcaggcccacaaccgcatcgacctcgatctgccaccacagtggacgccagagctcgctaggctgatcgggtacattgttgcggagggctacgtggagcagaggcctgataatacgggctacgtgtccatcacaaacaatgaccgggaggtgctggacgatgccaagagcgtcctggagactctcaacctgaatgtcaccgagcgctccagccacgaggggaagacggcgagggagctcctgtgcagcgctggcgagttcgtgtccttcctcgccagcctggacgagacactcctgcagtcgtctgctgagaggagggtcccgcaggatattatgagggcttccgacaacgtggtcaccgggttcattcggggctacatcgagggggagggccatgtgtcaacgtcccagcgcgagatcacagtcgcgagcatgtcgaagccgctcctggaggacgtcaggaccctcctggttacgcagggcattacagcccagctgcagccccggaacaatgggtcctacaggctcaggatctccggccagagcttccacgactacgcggagcagatcggcttcattactgcccgcaagaccgaggcttgcaggcagttcgaggggacgcatggcaacacaaatctggacattgtgccgaacctgggcccagagctcaggcgcatccgcgaggctctcgggctgactcagagcgagtgcggcctcccaaggtcgacctaccagcactacgagaggggcaggaggaatccctcgcgggattctctggagtcagtgctcgacgctttcgagactaggctggccgagatgaacaatgacactccaatttcggataccgctaggtctgacggcgggggcacgggctcgctcaggcaggatctcaacgggctggctgctctcgtggagggcgacatcgcctgggatcgcatcgagtccattgagcctatcgagcatgacgagaagtgggtctacgatctggagattgagggcacacataactacctcacaaatggggtcgtctctcataat

SEQ ID NO: 642 - DNA, 627 bp, Artificial Sequence
  Synthetic construct Hwa_MCM-1 codon optimized
tgcgtttcgggggagacagacatcgctctcgtggagggcaagaccgctactatcggggagctcgtggagtcggcgctgacagacccaaagccggttgacgatggcgtgtgggacaccgcggatttcaccgtgacgtcggctatcgagacgggcgagctcattgagcgggacgtcacacgcgtttggaagaggcagtcccccgagacgatgcggcagatccagattgctggcgggaggagcgtgacagtcactccatcgcaccccgttttcgtggagcataatgggtcttacaccgctaggagggctgactccctgagcgctggcgagtcagtggctatcgctgacgatgtcgccgactcacacccgatttccgtcgataacactgcgaataccctcaacccaaggtcgatgtctacgcctggcatcaccacggacggcgggctgtacaggacagggtccgatggcgggattgtccatgccgaggttggcaaggaggacgttactgattgcctcacaactgacaggatcaccgctgtgaagaccgtcacgccaacagctgagtgggtctacgatctggaggtggagggcacacacgcctacctcacaaacggggttctctcacacaac

SEQ ID NO: 643 - DNA, 1074 bp, Artificial Sequence
  Synthetic construct Hwa_PolB-2 codon optimized
tgcttcactcctgatacaaatgttctgacgcctaatggggttcgcaatattcgggatctcacggtcggggattcggtttactcgctgaacccggagaccatgcagatggagatcaagccggtgacacagactcacgagtaccccgactaccagggcgacctcatcgatattcagacaaacgagatcgatttccgcgtcactccaaatcataggatgctggttgaggctaccggcacggacaccacgtccaccaacgactacgatttcatcgaggccgggaatctcgatatttccagccggtacgagctgcctcacggctggtccgttgaccatacggatagcctcggggcctacatcgacctgattaccctcctgagggagcagtcagacacgtacaacgtcctctccgatggcgggatgacaactgctgctacggctgacatcaatcacaacaatgtcacccgcagggttgactctgatacgttcgtgtcactgattggctggtatgtggctacagggcgggtctcgcgcactcagaacggctctgacagggtctacctccagctgtcccagacaaatactaaggcgcggacccagctcacgatgctcctggacgagctgggcgtggactggcaggctgataacgagaagatccacttcgtgtctcatgtctggacggagctcttcgacaccacgtgcggccgcacagagaagaacaagcacatcccggagctgattttcgacgcttcagcctcccagaagagggcgttcttcgatgctatcattaacggcagcggggtcaagaatgacgattcgtaccagtaccacacctcgtctgaggacctcagggacgatatcctccggctgtgcgttcatatcggcattgtggcgcggtacgactacatcaacgatgagtcctggcgcattgagtgcaccgagacggccaatcccgacttcacactgactcatagcggcaggcagtcgacagctgaggatggggtttactgcgtgactgtggcggataatcagactctgctcgccgggaggaatggcaccttccagtggacaggcaac

SEQ ID NO: 644 - DNA, 1224 bp, Artificial Sequence
  Synthetic construct Hwa_RIR1-1 codon optimized
tgcctcactgcggactcaacagtcatgctcaaggagaaggggatggtctcggtctcggaggtggagacaggggatcagatcgctcagcgctccgacacaggcttccagtacaagccggtggaggagactcacgcgtacgagaacgctgagacactcactgtcaccctgacgaacggctgctctatccgcgggaccccgaatcacaggctcatggtcgacgatgagtggacgcgcatcgacgagattcagcccgatcaggaggttcattacacactcggctggctgagggagactaaccagtccccgcccaagctccactctcagtcacataccacggtgaatcagacagctgactccatcagcccggattccagcgagcccattgagctgtcggagtctgagaacgcggacacgggcaacaggcacaattctgctgttgccgtgaagcagtcacggacacagactcagctgatcagcgacgaggtggtctcgcggccagagcacaccaggaggcctgatcagctctccgaggagctggctgagctcctgggcctctggatcgacacggggctgtggcatcagagcggcgtccagttcaacgttgagcgcgagaatatcgcggagtacattgaccagctctcacagcagctgttcgataccccagctgctatctccgacacggatggcacctacacggtggacattacagatcataagctcaaggagtggtggaaggctaacttcggcgggaagccagacggcactcagtcgtcttacgtcccacagatgatcaaggaggcccctacaaatgttattgaggcgttcctgagggggtgcttcactgctgagggcgggctcaggaaggacatgaggccacggctgtgcacctcatccgaggatagcatcgacgatattgcggtcctcatgatgggcctggggtaccctgtggagaagtcggtcatcaggaacgctgacggcgagccgtactactcggttatgcccgctaccgacgatgggctctctgccttcctgcacgacgtgggcttcatcgatgagcggcgcgagatcgggctctccaacattgagagctcggatagccgggccctgaacaatacccataagatcgaggttgagtcaattgtggagtccccacctgcgacggtctacgacattacagtggcggataatcatgagtacgttacagatggcatcatttcacacaac

SEQ ID NO: 645 - DNA, 1314 bp, Artificial Sequence
  Synthetic construct Hwa_RIR1-2 codon optimized
tgcgtggaggagaatagcctggtttctaccgatgaggggctgcggcctatcaaggatctggacaatactactgcggagttcgagcagtgggacgagatcgatgtcggcgttaccacggacggcgggaccaagacggctacagctgtttacgataacggcttcgccaatgtgcgccagatccagaccgagagcgggttcaacattgctgctaccccaaatcaccggttccgcacgctgtccagcgacggcacttacacctggaaggaggctggcaagttcgagtccggggaccgcgtgatcctgcagaggaacaccttcgatgctggctcccgcgtgtccctggaggctaatgagagggctgacgatgcccaggacacaactgagggcccagagctgccagggaggatgacgtccgagctggccgagttcctcggctacttcatgggcagcgggtacatctcggacgagacccatgcttccgtggatctggtggtcgacagcgatgccacggagctcaactcatacctgtccaatctcggcgagcagctcttcaggattaccccggccgtcgagtctcaggagatgtcacaggttctgtccttccgggactgccacctcagccgctacttcgaggataacggctggaagaagacggacacaggccataatggggatgcttcggctgctttcgtcccagagcagatcctggagggcgacgagcaggttgtgaacggcttcctcaggggggtgttcgaggcgattgggacggtctcggagaagatcgagattctgaccacgtctacaactctggctgaccagctccagagcctcctgctctcgctgggccacgtgttcacccgggatagcacgaagctcgtcgagacaaacaattaccatgacgatcagctgaggcagaggctctgcggcgctactaggagggaggacgagcggttcatgaacgagatcgggtcactcattgagccagatgagctgaacctctccacacgcgcggacaagaatgatacttacccttcgtctgttatcgaccacgtgcagacactggacggctacgattcagtgtccgagagcctcaagtctcgcattaaccagtcacaggtcgacgggacggttagcaggaagctgatcaaggatattgaggcggagactgctgagaccgtctcgatcgccgaccatgagctcacaggcttctacgcggctactgtggagtctgtcacggaggacacagcgtacactaaggatatttcagttccaagcaacaacacatacatcgccgacgggttcgttactcataat

SEQ ID NO: 646 - DNA, 642 bp, Artificial Sequence
  Synthetic construct Hwa_rPol_App codon optimized
tctattgaggctgatgagtcaatcgttattaggcgggacggggagactgagctgacggagatcgggtcgttcgtggacactattctggccgcggacaaccaggagacccggatcacggatggccacgagattgcgctcgctccgaatgggctggaggttccctccctcgacaccgatgagcagatcaggtggaagcacattgaggcggtgagccggcatgcttcgccagacgagatcctcctgattgagctggagtcaggcaggtccatcagggctaccaaggctcactccttcgtcacgaggagggacggcgatgttctcccagtggctggcgagacactggtggtcggggacgtcctccctactgttggcagctacgatcatgcgtcggggtctatctcagtgccgctgcagtcccagagcgtcgctgctgacggcgggaccgttgagcccaacacaaatatcactgccaacgcggagcgcgattcggcctctattacctctgcgggcatcattgggtcggctacgtgggagaggatctccagcattgagacagtggcgccggagtacgagtatgtgtacgatctctctgtttccgggctggagactttcactacgggggagggggtcgttactcataat

SEQ ID NO: 647 - DNA, 1284 bp, Artificial Sequence
  Synthetic construct Kra_DnaB codon optimized
tgcctcactgcggggacaagggttctgcgggctgatacgggggcggagactactatgggggagctgttcgcgctgcaggctagggacgttccggtgtggtcactcgacgagtccctgcgctacgtccgcaggcacctcactagggttttcccaaccggggtgaagccagtcttccggctgaggactgctagcggcaagactgtccgcgctaccgctaaccatccattcctcacctacgatgggtggaagcctctcggcgagctgtcggtggctgacaggctggcggttccgaggcacgtgccagctccagagagggtggcttcatggacggacgatcaggtcctcctgctcggccatctcatcggcgatgggtccttcgtcaagaggcagccactccgctacgctagcgttgacgaggctaacctgtcggctgtgacggaggctgctgctaatgccttctccattgtcgcggttcgggacgagtacgctgctgctaggtgcaccacgctcaggctgccagctccttacaggctgacccacggcaggaggaatccactcgctgcttggctggacgagctcggcctgttcgggctcaggagctacgagaagttcgtcccgcaggaggttttccacctgcccaagaggcagatcgctctcttcctgcggcatctctgggcgactgatggctctgtgacgctgacaaggcagtcacgcggcgggaggatctactacgcctcgacatctctccagctgattcaggacgtctccaggctgctcctgcggttcggcattagcacgagggtgcggacaactaccccaaagggggaccacaggcctggctacacactcgatgtttctggcgtggacgatcagaggcggttcctgcaggagatcggcgtccatggggccaggggcgctaccgctgacaggctcctggaggtcatcagggatgtctccgcgaacacgaatgtcgacacagttcccaggcaggtttgggacgatgtgcgcaggctcctggtggagaaggagatgacgcacagggagttcgctgctgctatggggacatcgttcggcgggtccagcctctggaagcatgctccatctcgcgagaggctcggcagggtggcccaggtcctggactcggccgagctcgatgttctggcggtgaacgacgtcctgtgggatgaggtggtcgcgatcgagcctgacggcgaggagcaggtctacgatgctactgttctcggggggcacaacttcgtggcggatggcattgctgttcataat

SEQ ID NO: 648 - DNA, 1140 bp, Artificial Sequence
  Synthetic construct Mca_RIR1 codon optimized
tgcgttacggctgacacatgggttatgacggcctcgggggctaggcaggttcgggatctcattgacaggccattcgaggcggtcgtggacggcgagtgccacccaacagagtcccgcggcttcttcttcactggggataagcctgtgctcaggctgtcgacggctgagggccacacactcaggctgactgcgaaccatccggttctcagggtgtccaagatgaccaggcagctgcgggagacggagtgggttaaggctggcgagctcaggccacacgacaagatcgtcctccacgatcatagggctctgccatcctgggacggcgctcataccgaggctgagggctacctgatcgggctcctgattggcgggggcaccctcacgagggacaaggctatcctgtctatttgggatgctgctgctccaaaggtggctaacgggggcggctcagtcccagctgctggcgtcgccggggttatgagggctgctgagctcgctgctcggaccctgccacaccgcacggacttcaatggctggcagaccacgatggagggcaggggggagtaccacatggctacaggcgccctccatactctcgctctggagctcggcctgacaccaggggataagcgcctcactgcgcctctggagacaacttccagcgctttccacaggggcctcctgagggggatgttcgacgccgatggctcggttcaggggtctcagaggaagggcgtgtccatcaggctcccacagaccgacctcgggaacctgcagacggtccagaggatgctcctgaggctgggcgttgctagcaccattcatcagaataggaggccaggcgggaccaaggtcctcccagatggcgagggcggggctaaggggcactcatgccaggccgcgcatgagctgatcatttccggcgagaatgtggtcaggtacgctgagcggatcggcttcgccgactcggataagatggacaggctcaccgctctcctgcagaggtacaggcacacgaggcatgctgagaggttcatcgcgacagtgcagagcctggaggacgatggcatggaggccgtctacgatgttacagtggcggacgttcatgctttcgatgctaatgggctctacgttcataat

SEQ ID NO: 649 - DNA, 495 bp, Artificial Sequence
  Synthetic construct Memar_Pol-II codon optimized
tgcttcgcgggggacactgagattactgtttcggacgggcggcgctggatgtcgctccctattaggcagttcgttactgagaatttcgacatctcaaagccgggcctcgatcacgttgggacattctactccgacccaaggcagccattctacgtccgctcgattgattctcagggcaagacaagcctcaagcgggtgacttccgtcagcgttcacagggctccagctcatctggtccggttcgctaccaggagggggagggtcctcaccgttacgcctgaccatgcgatgctggtgtgggacacggattacctccgcaagatcaaggctctggaggtggctgtcggcgacagggttccagtggaggagggcgggctcgtggtcgctgatgaggttgtgtctagggagacggtgcaggctctggacgatcgggtctactgcctcactgtggcggagaatcatactctcgttgctaatggcatcttctgcgggcag

SEQ ID NO: 650 - DNA, 810 bp, Artificial Sequence
  Synthetic construct Mex_helicase codon optimized
tgcttcgctgcgggcactctcatcaagacaccaaaggggcctgttcctattgagcagattcagtcgggggatctcgttttcaatgcgatcggcattggggtggtcgagggcatcgtgtgccagcagaagcagaccattacgctggagctgtctgacggcacatcaatcgtctgcactcacgatcatccattcttctgccctcgcggctgggtcgctgctggcgacctggaggttggctccgggctgttcagccacgaggatctccgcaggctgtggtcgggcggggcttctctcggcctggagtccgggtccagcgacggcaggggggctgttcgctcgtctgaggtgctcctgaggatcctcagggaggaggctcgcgagccagatgctggctactgcgggccagccgaggacgtgcgcaacgcgtctaccgatagggctcatgctgagggcgcttggtggcagtggcaggctgacccgattgcgtcagatgaggctgctaggtccgctggcaggagggtcgctgaccgcgttagggacgaggataggagggaggctaggccagagccaaccgctgtcctcctgcaggacaggcactgcgagccactggctaacgatcggaataggagcggcagggagcattcatcccggggcacgggggaggctgagggccagcggcagggggacgtgccatgctcggtccgcgttgtgagcatctcgcgcgaggagaggggcgggcctgaggcggtgtacaacctcagggtttcagggcatccaagctacttcgctgggggggttctcgttcataat

SEQ ID NO: 651 - DNA, 495 bp, Artificial Sequence
  Synthetic construct Mhu_Pol-II codon optimized
tgcttccatggggacacactcattgagatctacgctgacggcattctggaggagattccgatcaggcggttcgttctggagcatctggatctctcgcaggctggcgtggacgctctggggacgttctacgctgatccggtccggccagctcacgtgcgctccgtcgacacaggcgggatcccacacctccgcaagattacttccgttagcgtgcataaggcccctgcgaacctgatccagttctcgacctctaggggcaagaatctcctggtgacgccggatcatgctatgctcgtttgggacgtgtcctacctccgcaagatcagggccctggaggtcaagattggcgacgctgtcccagtttgggagtcaggggtggtcatctccgacaggatcgtcagcattgattacgttccctgcgaggacgagcgggtgtactgcctcactgtggatagggatcataatgttgtgggcaatggcatcttcactgggcag

SEQ ID NO: 652 - DNA, 504 bp, Artificial Sequence
  Synthetic construct Mja_Klba codon optimized
gctctcgcctacgatgagcctatctacctctcggatggcaacattatcaatatcggggagttcgtggataagttcttcaagaagtacaagaacagcatcaagaaggaggacaatggcttcgggtggatcgatattggcaacgagaatatctacattaagtccttcaacaagctcagcctgatcattgaggacaagcggatcctccgcgtctggcgcaagaagtactcggggaagctgatcaagattaccacgaagaaccgcagggagatcacactcactcacgatcatccggtttacatctctaagaccggcgaggtgctggagattaatgccgagatggtgaaggtcggggactacatctacattcccaagaacaataccatcaacctcgatgaggttattaaggtggagacggtcgactacaatggccacatctacgatctgactgtggaggataatcatacttacattgctggcaagaatgagggcttcgctgtttccaac

SEQ ID NO: 653 - DNA, 1236 bp, Artificial Sequence
  Synthetic construct Mja_PEP codon optimized
tgcattgagggggacgctaagattctgacggatcgggggttcctgaagatgaaggaggtttacaagctcgtgaagaatggggagaagctcaaggtcctcggcctgaatgctgagacactgaagactgagtggaaggagatcattgacgctcagaagagggaggctaggcgctacgagatcggcgtgtaccgcaagaataagaacaccaaggacacgatcaagattacaccggatcacaagttccccgtgttcgtcaacggcgagctcagcaaggtgcagctgtgcgacatcattgataacaatctctcagtcctgtccatcgactacattccaatgatcgaggagaagtacgagtccctcgctgaggtcatgtacctcggcggggctgtcctgagcgatggccatatcgttcggaggaacgggaagccaattcgggtccgcttcacacagaaggacactgaggagaagaaggatttcatcgagaaggttaagggcgacgtgaagctcatcggcgggaatttcatcgagatttcgaaccgcaacaatgtcatcgagtaccagacctctaggaagattccgtcagagatcctgggcttcattgaggttaatattaacacaatccccctctacgccactaaggacgagatcgccgatctgattgcgggcttcgttgacggcgatgggtgcctctccgggaagaggagggtggagatctaccagaactccagccacattaagaagatcgagggcctcatcgtcgggctctacaggctgggcatcattccgaggctgcggtacaagcggtcgtctaccgcgacgatctacttcaacaacaacctggagaccatcctgcagcgcacgcgcaggattaagctcgacaagctgaaggagttcaagaagccagtggaggacaagaagctgatcgatatttcgcagatcctccctgagctgaaggagttcgactacaagggctacctctacaagacctacaaggagaagctgttcatcgggattaacaagctggaggagtacctgtctaagatcgacaaggatggcattgagcgcatcaagcagaagatcaagctcctgaaggagagcgacatctactcgatcaggattaagaaggtcggcgaggattacggggaggtctacaatatcacggttaaggcggagaacgagttcaatcataactacgtggtttggactaagcattacacacctatcgtggttttcaac

SEQ ID NO: 654 - DNA, 1428 bp, Artificial Sequence
  Synthetic construct Mja_Pol-2 codon optimized
agcattctccctgacgagtacctgactattattgaggaggatggcattaaggtcgtgaagatcggggagtacattgatgatctcatgcgcaagcacaaggacaagatcaagttctcgggcatctctgagattctggagacaaagaacctcaagactttctccttcgataagatcacgaagaagtgcgagattaagaaggtgaaggcgctgatcaggcacccatacttcggcaaggcttacaagatcaagctccggtctggccgcaccattaaggtcacgagggggcattcactgttcaagtacgagaacgggaagatcgtcgaggttaagggcgacgatgtgcggttcggggacctgatcgtggtcccaaagaagctcacctgcgtcgataaggaggttgtgatcaacattcctaagcggctgatcaatgctgacgaggaggagatcaaggatctcgtcattaccaagcacaaggacaaggccttcttcgttaagctcaagaagacgctggaggatatcgagaacaataagctcaaggtcatcttcgacgattgcattctctacctgaaggagctcggcctgatcgactacaacatcattaagaagattaataaggttgacatcaagattctggatgaggagaagttcaaggcctacaagaagtacttcgacaccgtcatcgagcatggcaacttcaagaaggggcgctgcaatattcagtacatcaagattaaggactacatcgcgaacattcccgacaaggagttcgaggattgcgagatcggcgcctactcggggaagattaatgcgctcctgaagctcgacgagaagctggctaagttcctcggcttcttcgtgacacgcgggaggctgaagaagcagaagctcaagggcgagactgtctacgagatctcagtttacaagtccctcccggagtaccagaaggagatcgctgagacattcaaggaggtcttcggcgccgggtccatggttaaggacaaagtgactatggataacaagatcgtgtacctcgtcctgaagtacattttcaagtgcggcgacaaggataagaagcacatccccgaggagctcttcctggcctccgagagcgtgatcaagagcttcctggacggcttcctcaaggccaagaagaacagccataaggggacctcgacgttcatggcgaaggatgagaagtacctcaaccagctgatgatcctcttcaatctggttggcattccgacaaggttcactcccgtgaagaacaagggctacaagctcaccctgaatccgaagtacgggacggtgaaggacctcatgctggatgaggtcaaggagatcgaggcgttcgagtacagcggctacgtctacgatctctctgtggaggataatgagaacttcctcgtcaacaacatctacgctcataat

SEQ ID NO: 655 - DNA, 1629 bp, Artificial Sequence
  Synthetic construct Mja_RFC-3 codon optimized
tgcctgacgggggacgctaagattactctgcctgacgagcgggagatcaagattgaggatttcattaagatgttcgaggagcgcaagctgaagcacgtcctcaacaggaatggggaggacctggtgctcgctggcgtcaagttcaactccaagatcgttaatcacaaggtgtacaggctggtcctggagagcgggagggagatcgaggctaccggcgaccataagttcctgacgagggatggctggaaggaggtgtacgagctcaaggaggacgatgaggttctggtgtacccggctctggagggcgttgggttcgaggtggacgagcgcaggatcattggcctgaacgagttctacgagttcctcacaaattacgagatcaagctggggtacaagccactcggcaaggcgaagtcatacaaggagctgattactcgcgacaaggagaagatcctctctagggtcctggagctctccgataagtactccaagagcgagatccggcgcaagattgaggaggagttcggcatcaagatttctctgaccacgatcaagaacctcattaatgggaagatcgacggcttcgccctgaagtatgtgcgcaagatcaaggagctcggctgggatgagatcacctacgacgatgagaaggctgggatcttcgccaggctcctgggcttcatcattggcgacgggcacctgtcgaagtctaaggagggccggatcctgattacagctactattaacgagctggaggggatcaagaaggatctggagaagctcggcatcaaggcctcgaacatcattgagaaggacattgagcataagctcgatgggagggagatcaagggcaagacctctttcatctacattaacaataaggccttctacctcctgctcaacttctggggggtcgagattggcaataagacgatcaacgggtacaatattccaaagtggatcaagtacggcaacaagttcgttaagagggagttcctgaggggcctcttcggggctgacggcacaaagccttacatcaagaagtacaacatcaatgggattaagctgggcattcgggtggagaacatctccaaggataagactctggagttcttcgaggaggtcaagaagatgctggaggagttcgaggtcgagagctacattaaggtttcgaagatcgacaacaagaatctgaccgagctcatcgtcaaggccaacaataagaactacctgaagtacctctcaaggatctcctacgcgtacgagaaggacaatttcgctaggctggtgggcgagtacctccggatcaaggaggcgtacaaggacatcattctgaaggagatcgccgagaacgcgctcaaggaggccgatggcgagaagagcctgagggagctcgctaggaagtacaacgtcccggttgacttcatcattaatcagctgaaggggaaggatatcggcctcccccgcaacttcatgacgttcgaggagttcctcaaggagaaggtggtcgacggcaagtatgtgtccgagcggatcattaagaaggagtgcatcggctaccgcgatgtgtacgacattacttgccacaaggatccttctttcattgctaacggcttcgtctctcataac

SEQ ID NO: 656 - DNA, 1482 bp, Artificial Sequence
  Synthetic construct Mja_r-Gyr codon optimized
tgcctgacaccggacacatacgtggttctcggggacgggcggattgagactattgaggacatcgtgaatgctaaggagcgcaacgtgctctccctggacctcgataacctcagcatcaagattgacacggcgatcaagttctggaagctgcgctacaacggcaatctgagcaagatcacactctcgaacaattacgagctcaaggctactccggaccactgcctcctggtgctgagggataaccagctcaagtggatccccgccaaggacattaaggagaacgattacatcgcgatgccgttcaattacaaggtcgagcggaagcccatctccctcctgaacctcctgaagtacctggacatcacagatgttctcattgagttcgacgagaactccactatcttcgagaagattgccgagtacatccgcaacaatattaagacctcaacgaagtacaagtacctcaggaaccgcagggtcccgctgaagtacctcatcgagtggaatttcgacctggatgagattgagaaggaggctaagtacatctacaagtccgttgccgggaccaagaagatccccctgttcaagctcgacgagaggttctggtacttcgctggcctggtcctcggcgacgggtcgatccaggattctaagatccggattgcccagaccccactgaaggacgtgaagagcattctcgatgagacgttccctttcctgcacaactggatctcgggcaatcaggtcatcatttctaacccaatcattgccgagatcctggagaagctcggcatgaggaacgggaagctcaatggcatcattttctcactgcctgagtcctacatcaacgccctcattgcggggtacttcgacaccgatggctgcttctcgctcctgtacgacaagaaggcgaagaagcacaacctgcgcatggtcctcacgtcaaagcggcgcgatgttctggagaagatcgggatctacctcaactccatcggcattctgaatacactccataagtctagggaggtgtactcactcatcatttccaacaagagcctggagactttcaaggagaagatcgcgaagtacctgaagattcggaaggaggctttcatcaacggctacaagacatacaagaaggagcatgaggagcgcttcgagtgcgacctcctgccagttaaggaggtgttcaagaagctcaccttcgagaagggccggaaggagatcctgaaggactccaagatccacattgagaactggtacaaggagaagaccaacaatatcccgagggagaagctgaagacggttctccggtacgcgaacaatagcgagcataaggagttcctggagaagatcgtgaacggggacatttcgttcgtgcgcgtcaagaaggtggagaatatcccgtacgatggctacgtctacgatctctctatcaagcataatcagaacttcatctctaatggggtcatttcacacaac

SEQ ID NO: 657 - DNA, 951 bp, Artificial Sequence
  Synthetic construct MP-Be_gp51 codon optimized
tgctcgtggacaaacgctagggcggttacaaggcgggggttcgtgcatgtggatgatctcactactgatgatgaggtcatgtcggtcgacgatcagggcaggacaatctggcagcagattgacgaggtggtccggttcccgttcagcggcacgctctactcgctgggcgggagggagatcaacgctaccattacggccaatcaccgggttgtgggcctcaaccgcgagaagaccaagtgggttgagcatacaccaacttccctgcctggcaacaagatgtgggtgtacaccgctggcgaggggagcaatgaggactacccgctcaccgatacggagatcaggctcgctgtgtggggcctgacagactcgcacaggtctcccgatggccggtggactttctaccagtccggggagaaggcggagcaggtcaggaagctcctggctgacgctggcattgagtacagggagagggctaggaacaggggcatcaccgagattgatgggaaggtcctcaaggcgccgcccaagacgcagtacgagttctcgctcggcaaggttcaggagctggacgatctcctggacagggggaggagcgagctgccaacatggactctctccctgagccagaggcaggctaggctcttcctggaggagtacaggttcaccgacggcacggataccacgtcagctggggactcctacgtcctctacgtttgcaaggatcgcatgagggagcagctccagatgctggctgctgctaacggcctcagggcttccacaactgagtacaggccagggcattggaggctgaacatctctaatagggcgctctcaggcctgtacaagaataccgtggaggaggtcgcttacgagggggaagtgtggtgcctgcgggttccaaatggcaggttcttcattgaggatgggggcaagattcatctcacgggcaac

SEQ ID NO: 658 - DNA, 1221 bp, Artificial Sequence
  Synthetic construct Nsp-PCC7120_RIR1 codon optimized
tgcctccctgaggatgcgctggttcataccgctaaggggctggtccctattcgggatgttcaggtcggggatctcgttcagacaccgctcggcttccgcagggtggtcgacaagttcgatcagggcttccaggacgtgtacgagatcgagactaacgcgacctacccacgcgctacgctcaatcacaggcaggctgtcctggaggacgctaagggcgggatcgtttggaagcatattgcttcgctggaggccggcgataggctcctgcacaacaagcaggtcctcccgggcactgttacccatctgcccgcggacttcactgagagcaggccatcacactcccggaccgccaagtcgttcgttgtgcctgagctcacggctgaggtggcttggctgatcggcttcacacatggcgacggctacgtggctctcggcaggaacaagtacgataagccgtacgggcgggttgagtggtccatgaactccctggacgctgaggtcacctcccgcatccaggctaagattgatgctgctctcgctctgttcggcctctccgctgtccacagcatcacgaagggcgagaacacagctaagagcatctgctccagcattcggctggccgagtacttccaccgccatatcaagcagccaaatattcctctcactgtgccgtcattcatcctgcagggctccgtcgacattagggctgcttacctcgctggcctgatggactccgatggggctgtgaacaataggccaccacacctcatcacatcggtgtaccggtctttcattcgccaggtctcggtcgttctctcgtctctgggcatcgccgggaggctgaccacgacatacccccagaactctaattggcaggtcaagtacaacctcacgatcccggcgctgaaggagcgctacaatgctctcatttctccccattcagccaagggcgagctcaggcaggggctgaagatgtacggcttcacggttccaggggccgtgatgcgggagacgtacacatactctgagatgagggagatgggcttccaggggtcacggacagttgacgccaactacgagcgctacgtggcggaggctgacatctccctcgatattcctgtgactgtcaagggcctggggagctacgatcacgtgcagacctacgacattgaggttgatgaggctcattgcttctactgcgatggctacctcacacataat

SEQ ID NO: 659 - DNA, 1146 bp, Artificial Sequence
  Synthetic construct Pab_RIR1-3 codon optimized
tgcgtggtcggggagacaaggattctgacgcctgagggctacatcaaggctgaggagctgttcaagctcgccaaggagcggggcaagatggaggccatcgctgtggagggcattgctgagggcggggagccatacgcgtactctctggagatcctcctgcctggcgacaagcaggtcaagtacgagaccgttcacgggaacgctgtggaggtcgccgatccggtttcagtgcccgcctacgtgtggaaggtcggcatgaaggaggttgcccgcgtgaggacaaaggagggctacgagatcaccgccacgctcgaccataagctgatgactccggagggctggaaggagatcaaggacctgaagccaggggataagattctcctgcctaggttcgaggtggaggaggacttcggctccgagagcatcggggaggatctcgcgttcgtcctgggctggttcattggcgacgggtacctcaacgttaaggataagcgggcgtggttctacttcaatgctgagaaggaggaggagatcgcctggaagatccgcgagattctggctaagaggttcgagatcaaggccgagccacaccgctacggcaaccagattaagctcggcgtcagggggaaggcgtacgagtggctggagtccatcgttaagaccaacgagaagaggatcccggagattgtgtaccggctcaagcccaatgagattgcctcattcctcaggggcctgttctccgctgacggctacgtggacaatgatatggctatccgcctcacgtcgaagtctcgggagctcctgcgcgaggtccaggatctcctgctcctgttcggcatcctgtccaagatctacgagaggccgtacaagcgggagttcaagtacaccacgaaggacggcgaggagcgcacatacacaactgaggggtactacgagctcgtgatcgcgaactactcccggaagatcttcgctgagcgcattggcctggaggggtacaagatggagaagctcagcctggagaagatcaaggtcgacgagcccattgtcaccgttgagtcggtggagatcctcggcaagaagctggtctacgacttcactgttccagagcatcacatgtacatttccaatgggttcatgagccacaac

SEQ ID NO: 660 - DNA, 1566 bp, Artificial Sequence
  Synthetic construct Pfu_KlbA codon optimized
gctctctacgatttctcggttattcagctctctaatgggcggttcgttctcatcggggatctcgtggaggagctgttcaagaagtacgccgagaagatcaagacctacaaggacctggagtacattgagctgaacgaggaggataggttcgaggtggtctcagtctccccggacctcaaggcgaataagcacgttgtgtctcgggtgtggaggaggaaggtccgcgagggggagaagctgatccgcattaagaccaggacgggcaacgagatcattctcacacgcaatcatcccctgttcgccttcagcaacggggatgtcgttaggaaggaggctgagaagctcaaagtgggcgacagggttgccgtgatgatgcggccgccctcaccacctcagactaaggcggtggtcgacccagctatctacgttaagatttccgattactacctggtgccaaacggcaaggggatgatcaaggtccctaatgacggcattccgcccgagaaggcccagtacctcctgtctgtgaactcataccccgttaagctcgtgagggaggtcgatgagaagctcagctacctggctggggtcatcctgggcgacgggtacatttccagcaatggctactacatctcggcgaccttcgacgatgaggcgtacatggacgctttcgtctccgttgtgagcgatttcatcccaaactacgtgccttccattaggaagaatggggactacacaatcgtcactgttggctctaagattttcgccgagatgctctcacggatcttcggcattccgcgcgggaggaagtccatgtgggacatccccgatgtcgttctcagcaacgacgatctgatgcgctacttcatcgccggcctcttcgacgcggatggctacgtggacgagaatggcccgagcatcgtgctggtcaccaagtcggagacggtcgccaggaagatctggtatgtgctccagcggctgggcatcatttcgacggtttctcgggtgaagtcgcgcggcttcaaggagggggagctcttccgggttatcatttctggcgtggaggatctcgctaagttcgccaagttcatcccactgaggcactcccggaagcgcgctaagctcatggagatcctgcgcacaaagaagccttacaggggcaggcgcacttacagggtcccaatctcgtctgacatgattgctccactgaggcagatgctcgggctgaccgtggctgagctctcaaagctggcctcctactacgcgggcgagaaggtcagcgagtcgctcatccgccatattgagaaggggagggtgaaggagatcaggaggtcgacgctgaagggcatcgctctcgctctgcagcagattgctaaggatgtgggcaacgaggaggcttgggtcagggctaagaggctccagctgatcgctgagggcgacgtctactgggatgaggtggtcagcgtcgaggaggttgacccgaaggagctgggcatcgagtatgtgtacgatctcacagtggaggatgatcataactacgttgctaatggcattctcgtttctaat

SEQ ID NO: 661 - DNA, 1332 bp, Artificial Sequence
  Synthetic construct Pho_IF2 codon optimized
tgcctgctgccggaggagcgggttattctgcctgactacgggcctattactctggaggagctcttcaatatgacaaaggagacagtgttcaaggacgaggagaaggaggtccggaagctcggcatccgcatgccagtggctggcgtcgatgggcgggtgcgcctgctggagggcccctacgtttggaaggtgcgctacaaggggaagatgctcagggtcaagctgaaggactggcacagcgtggctgtcacaccagagcatcccttcctcaccacgcggggctgggtgcgcgctgaccagctgaagcccggggattacgttgccgtgccaaagatcctccctgggaaggacgataaggagaagttcctccagtatgtgcacgagaagctgaagggcaaggttcatattaagctgccgtccagcgacgaggagtgggagacattcttctacttcgccggcactatcttcgggcgcgagaactcggtgaatccagagggcctcacccacgaggtcaaggctctcctggagctcttcaaggttctgttcgagtacccgagggaggtcctccgggttctgttcatggccccggtgcgctacgtggcgaacttcctccgcggcttcttcgacattaacggctacgtcaatggggaggagctgagggtcgaggttaggggggctccacatgaggttctggaggagctctccctgatcctcctgaggctgggcatcgtgtccaagatctaccctacgagcctggctatttcgggcaggaggaacctggagctgttccggcgctacatcgggttctcggagaagcagaaggccaaggagctggagggcatcattaggcggtctgagaactcagagtcctacccaattttcgaggagctgcgcaggatcaggctcctgttcggcttcacccgggcggagctctcgtctacgatcccactgtactctaagtacgagtcaaaggaggctccttcatacgagatcctcatgaagattctgaatacaatcgagaaggggtctaaggacctcaacaagaagatcactattctggagggcagggtgcgggatcacgagtacattgaggagttcaagcgcgagggcctgatcaaggacgggaagctcaccgagctgggcaaggagctcctggaggtctggcgcaacagggagttcgactccagggatgtcaactacctccggaatatcattgagaacttcgttttcctgccggtggagaagatcgaggagttcgagtacgatggctacgtctacgacgttactacagagactcataatttcattgctaatggcatcctcgttcataat

SEQ ID NO: 662 - DNA, 1230 bp, Artificial Sequence
  Synthetic construct Pho_r-Gyr codon optimized
tgcgttaccccagacacgctggtttcgctctcggacgggcggattattgagatcagggaggcggtggagaactcggaggagtcgctgctcgggatcaacggcctgaagccgaaggaggccaaggcgctcaagttctgggagatcgactgggatgggccgatcaaggtcatcaagctgaagaatggccacgagatcaaggctaccccagaccatgggctcctggttatgagggatgggaagatcggctgggtgtcggctaagaacattcgggagggcgactacgtcgccttcatctacaatctcgggcaccgcggcgggaagaagtacacgctcccccagctcctgaaggagctgggcatctccgagtacgagaactccagctcgcaggagctcaacaatcgcgagcaggagatggactccaagcagatcagcattgagctggatgagaggttctggtacatcttcggcgtgattctcggcaaggggaccctgaagggggacaaggtggtcatcttccagaaggatgtcaagccggttattgaggaggcgctgcccttcgtccggatcttcgagtcggctgaccacatcggcttctctcatctcattctggctgaggtcttccgcaggctcggcgttggggagggcaagctccactccctggtgttcggcctgagggaggagtacatcaacgctatgattgccgggtacttcgacgctagcggcaccttcctcaggagggctgtcctgacgagcaagcgcggcgatatcctcaggatgctgtcggtgtacctctaccagatcggcattgtcaacaatctgaggagggacgagcatgctggcgtgtgggagctcatcatttctgatctggagaagttccgcgagaagatctacccttacctcaggattaagaagtcacagttcgacaaggtctactctatttcaaagaacgagggcgatttcctcccggttgcgtctatcttccggaagctgaagttccgcgacggcttcaagaatcggatcctcgacgaggagattccacgcgatgaggtggcgaaggtcctggagtacgctgaggactcacctgagaaggagttcctcaactccctggttgaggccagggtgacatgggttcgggtggagaagatcgaggagaggcattacactggcaagctctacgacttcacaactactacagagaacttcatttccaatggcatcgtctcacacaac

SEQ ID NO: 663 - DNA, 1368 bp, Artificial Sequence
  Synthetic construct Pno_RPA2 codon optimized
tgcctctctgcggatcatgaggttctcacatctacagggtggaaggctctccccgctattaaggatgcggatcaggttatgacgctggacctccagacgggcacacagcagtggaactcggtgcaggctaccacgaggttcgcgcgggagggctcactctacaggctgaagtccgacgatatggatgcggtctgcaacgagtctcaccgctggtacctcaatactaaggaccagccaacaacttacaccgctttcaccacgcagcagatgctggataaccagctcgtggctctgcgcaactcctccggcaaggctacggaccagtggaaccacgagtccgggacaactacccacacgaaccataatatccctacagtcggccataacgggaatgttatgttcagctggccagactgcccatggctcccacgcgagttcgtcgctgatgaggcgtgcaacctcgactggtgcaggttcatcggcctcgtgatgggcgacgggtcgattgatcatgtcacggacgctcagggccaggagcactacagcatccagattcatcagagggctgggaacccagcttcgaacgctaatacagaggatgtcctggagaggctggctgctaagctgccaaatttcgtggtccacccatcctgcgttagcggcgcggaggagaagcatacttggaccatcaaccaccgggacatgtaccatttcttcctccccatgatgcgcggcccacagtcctacgaccctctggataacgccatgtgcaggacctaccaggctccagattaccaggccctctcgcggtctgacaatgagcctatcattccagtgccagctgactggaagaccggcaactggtggcacctgcgcaggtggatcaattacccatggctcttctcgctggcccagtctcaggcgagggctatgattaagggcatggctgccgcgaacggggattggtcactctccctgaaggctaggctggacaccggcgattctggggttgtgagggttttcagcaattcgatccccctcatgcacgacatgtcagtgctgggcctcctggccgatactcgcgtgaacattggcgtcgaccataagaaggggcagatgcagctccaggtccctgttaccatgccggcgctcctggcttggtgcatctctttctcattcgcgaactccgacctggctgtggctgctccaaagcctgaggcgtacgataatccgaggcacgacggcttcgtttactgcctcacggtgcccaacgggaatttcctggcccggcgcacagtcgagtacagcgataatgataagattcaggaggtcattgatgctgctcagaagcctttcttcacaggcaac

SEQ ID NO: 664 - DNA, 1044 bp, Artificial Sequence
  Synthetic construct SaP-SETP3_Helicase codon optimized
tgcctcaagcgggggacagaggtcattatgttcgatgggacaactaagaaggtggaggacgttatcgtgggggacgttctcatggggccagacagcacccctaggaacgtgctctcgctgggcagggggagggagatgatgtacgaggtgaagccacggaagggcgagtcctacacggtcaatgagtcacacatcctctccctgcgcaccacgacaggcattgcgaaggggtcctggcctgacaacacagtcttcgatatcagcgttcgggactggctcaagctgccaaagtatgtgactggccctaatgggtacctcaagggctggagggtgccagtcgatttcccaaggaaggagcaggacgaggctctcctgccaccatacctgatgggcctctggctgggcgacgggacttccagctcgggcgctatcacctcgggggagaatgagaaggagattagggcttacctggagtcttacgctgctaggaacggcatgcagatcaggaaggaggggctgacttggtctatttcacacggcaacaccgggcacaagaagcatggcttcacgcatgcgctcaagagcgctggggtgctgaacaataagcacatcccgcataactacaagtgcggcgataggaggcagaggctggagctcctggctggcctcctggactctgatgggtactgcgatctctcaaaggctggcttcgactggatttccgttagcgagaggctggccgacgatttctgctacctctgccggtcgctgggcttcgctgcctacaagaagaagacctgcaagcgctgcgcgaacacagacgtctggggcgattacttcagggtttcggtgtctggggacttctccgaggtgccattcgtcaggggcaggcatcagaatctccccaagcgcaacatcaataagaacgttctgaacgtgggcatcgagtccattacccccgtcggcgttgacgattacttcgggttcacaattgatggggattcaaggttcctcctcggggatttcacagttactcataatacc

SEQ ID NO: 665 - DNA, 1260 bp, Artificial Sequence
  Synthetic construct StP-Twort_ORF6 codon optimized
tgcatttctatggactctatgattctgacaactgagggctacaagtcgctgcaggagattttcgagacacagggggttaaggtggacaacaaggagaaggttatcgagctgaagtacccgctcattaatcggtacggcgacgtggagtacacctcccacttcacgaagaacggggagaagccaacaaagcgcatcaagactaataagggcattgagctggttaacacatacaatcatcctctcctggtgagggaggggttcaacctgatctggaagaagagcgaggacatcgaagtgggcgatattctcgtgtcccgcgtgggcgaccaccagttcgggaacaataacactgtggagaacgaggaggaggcttacgctctgggctgcatggtcgcggattcttacctggggtcatactcccggctcagcttctcgaacgacaagaaggagatcctcgataaggtctcaaagttctggaacaccttctccaataaggaggtttactacgacacctacaaggagtccaaggggatcacgattcacctgcatgacacaaacaagactaaggagttccatgataagtacaagatcgagtacggcgtcgctaaggacaagaagatcccgaagtgcattatggagagccccgagaacatccagctggccttcgtctcgggctacctggagtgcgagtccagcatctctgagaagaacctggaggttacctctgcttcaaaggacctcctgaaggatctccagctgatcctctcgaacatcggcattgtgtctacgaataaggagaaggtggtcaagaagtacaagcacaacaagtactaccggctgatcgtcaatcgcaaggagctcattaagctcctgccgctcctgaggttcgagacgcagcagcggaagaaccagaaggagaatttcctcagcaataacacaaagatcaagtcgtcttacggcaacactattgaggggtcacgctacctcctgaagaagtacagggactccctgaatatcgataagaaggagttctccaagtacctcagccgggacaccatcacgattgatcgcctgagggaggtcatctcgctctacccggacggcgataaggagattcgcgagctgttcgagaacgttgtgaataacaatatctactaccagaaggtggagcaggtcctggagggcgagatcattcccaccttcgacgtttgcatgcctaagactcattccttcatcgccaacacaatcgtcaaccacaac

SEQ ID NO: 666 - DNA, 1284 bp, Artificial Sequence
  Synthetic construct Ter_DnaE-2 codon optimized
tgcctctcggggtctacaaaggtcattgacgctgctacggggaatctcttctcgctcaaggagatcgccgctcagcctgagtactggctctcgcgcaaggtcttctctctcgacctgaagtcacagcaggtggtccagcagccaatcaccgagattcaccctaatggcgtgagggatgtctggcagatcaccacgaggaccaacaggaaggtgtgcgctacggacgatcatctcttctacacagtcctgggctggaagccgctcaaggacttcagcgttggcgatcgcctcgggctgccgaataagatccccattaactacaggtcccagatctccgacagcaaggtgaagttcacggcgtacctcattggcgaggggtacctgtacacaaattcgttctcttgctcatacttctgcaactccgacggggagctcatcgcggatttctacggctgcgctgaggagctgttcgggtccagcgctccaatcgagaagcagctccacctgggcaataagtccgtgatctacgtgcggatcggcctcatttccgggctgaagaactgggtcgactcctacctccagtgcgcgaatagccgcgtgcaggagatccccaactggattttctccctcagccagtcgcagctccagctgttcctcggcatcctgtggtctacgtcagggatcttcgacgagacaattggctacacttactactcgtctaacagcgaggtcctggttaggcaggtccagcatctgttcctccggctgggcatcgtttccctcttcaacgtcaataaggttaagggccagggggagctggacgtgtcctacgttgtggaggtccgcgggagggaggatatgctgaagttctacaagctcatcaagccgtacctgtcatcctacaagcagggcctctgcgagagctgctacctggtcattaagtaccagcagtcgtaccagttcaagtacttcctcactcccgacttcttcgatctgatcgtgaaggctaagaaggccagctcgatgaccagggctctcggcgtttgcggcggggagatctcttcagtgtggaacttccagaatacatctaaccggtccctgagcttcgacaagttcaacaatttctcgactgtcctcgcggatgaggagctgaccgccatcgcgaactcggacgtgttctgggatgagatcatttctatcgagtacattggcaaggaggaggtgttcgatctcactattccagagactcataacttcattgctaatgacttcatcgtgcataat

SEQ ID NO: 667 - DNA, 969 bp, Artificial Sequence
  Synthetic construct Ter_RIR1-3 codon optimized
tgcgtttcgggggatacgctgctgattacaagggactctattcataagattaaggatgtcgtggggcagaagattgagatttggaatggcaagaactggtctcaggtcatcccgctgaagacagggaaggacaggaagctctaccgggttcgcttcggcgacgggtcgtacctggatgttaccgagtaccaccgcttcttcgtgaaggacaggttcggcaagaagtacgaggaggtgcagaccaaggatctcctgacgcactccaagtacgccctggacgtcgagccattcatcattgattaccatgacggcgattcgatcaacctctcttacgcttacacactgggggctgctctcggcaatgggactatcgaccagaactctaatggcaagattagggtgtactcacataaggccgagctgatcttcgcgggcaacaagtccctggagcggcagtacaattacctcccgagcttcgtggacgtcattgatctcggcttctcgggggagctcctgaggaggctgcagaccgagcccgacgctctcaacacgatcgcctcatggaataagtccgctatcctggccttcattgcgggcctcgctgacacagatgggagcgagactaagggcaacgggatcaagatttccgtgagcgactacgagagggccaagcggctgcagctcctgctcacgaagtgcggcattagggcgagcgtcaatctgatggcttcgcggggctgcaccacgaacctcggggagcgcaatcaggacctgtactacctccagatcaccgattgccgggagattccatgccagcgcctcgacacaactaaggtttgcgaggcgaagttccagggcaagtaccagaccatccagaacgtcgaggagctgcctggcctccacgatacgtactgcttcgaggagccagagttccacaagggggttttcggcaatgctctcacaggcaac

SEQ ID NO: 668 - DNA, 1209 bp, Artificial Sequence
  Synthetic construct Tko_Helicase codon optimized
tgcatgcatcctgacacatacgtggttactaagtcgggggctaagaaggtctctgagctgactgagggggatgaggtcctgacacataccggcacgttcaagaaggtcatccagccactgaggagggagcacaaggggcgcctcctggttatcaaggcctacggcaccgtgcctgtcaagattacgccggagcacatggtttgggtggtcaagcagatcaggcacaagtcccattacagcgatgggcggcaggtcatttggtgggagttcgagggcccagagtggatgacggctcaggagctgaaggagcgcctggagtccgagacagacccaaaggtgagctacatgctcctgcagccaatccctgagccgtccgtggacgcggataagattcctctgaggaaggaggtctacgttgtgaaccagcacggcaagacagacaagctccatccgtccgtgaagcggactcccgagtacctgccactcaacttcgagaccgctaggctgatcggcctctggattgctgaggggtcaacttccaagaacggcgtcatcaagttcgacatttccagcaatgaggaggatctgacggagttcatcacaggcactattaggaagtacttcccgcacgctaagatcgtcgttaaggaccatgagaggaacaggaggacggtccggttctgcaataagcgcttcgcggagtggctcagggagaacatcggccacggggctgataataagagcattccgcccctcctgctcctgaacaagaatagggaggtgcgcctgggcctcctgagggggctcatcgagggcgacggctacgtgcgcagggagtcgcagcgcagggcgaactacatcagctactcgacagtttctccctcactggcttaccagctccagctcctggtggcttcgctgggctacacctcgtctatccacaggtctattcggacagagggcatcgggaagactaggaagcccatctacgatgttaaggtgtcgggcaagtcttactactcactcctggaggagctcgggttcgaggtcccacagaggggcaacaggacctacaacgttaatcgcacgtggaagaattacctcctgctcaaggtgaggtccatcgaggaggaggagtacgagggcgacgtttacaatctggaggttgagggggatgagtcaggctctgtgggcttcatcgtgcataat

SEQ ID NO: 669 - DNA, 1608 bp, Artificial Sequence
  Synthetic construct Tko_Pol-2_Pko_Pol-2 codon optimized
tctattctgcctgaggagtggctgcctgttctggaggagggggaggttcatttcgttaggatcggggagctgattgaccgcatgatggaggagaacgctggcaaggtcaagagggagggggagaccgaggtcctggaggtttcaggcctggaggtgccgtccttcaaccgcaggacgaataaggcggagctgaagagggtcaaggctctcatccggcacgactactctggcaaggtgtacaccattaggctgaagtcaggccggcgcatcaagattacgtcagggcattccctgttcagcgtccggaacggcgagctcgttgaggtgaccggcgacgagctgaagccaggggatctcgtcgctgttccaaggaggctggagctgccagagaggaaccacgtcctcaatctggttgagctcctgctcggcacaccggaggaggagactctggacatcgtgatgacgattcccgtcaagggcaagaagaacttcttcaaggggatgctcaggacactgcggtggatcttcggcgaggagaagaggccaaggactgctcgcaggtacctcaggcatctggaggacctcggctacgtgcggctcaagaagatcgggtacgaggtcctggactgggatagcctcaagaattaccggcgcctgtacgaggctctcgtggagaacgtccgctacaacggcaataagagggagtacctggttgagttcaattcgatccgcgacgccgtggggattatgccgctgaaggagctcaaggagtggaagatcggcacactcaacgggttccggatgcgcaagctgattgaggtcgatgagtccctcgccaagctgctcggctactacgtgagcgaggggtacgcgcgcaagcagaggaacccgaagaatggctggtcgtactctgtcaagctgtacaatgaggaccccgaggttctggacgatatggagcggctcgcgagccgcttcttcggcaaggttaggcgggggaggaactacgtggagatccccaagaagattggctacctgctcttcgagaatatgtgcggggtgctcgctgagaacaagcgcatcccagagttcgtcttcacatcacctaagggcgttaggctggccttcctggaggggtactccagcgctatggctacctccacggagcaggagactcaggcgctgaacgagaagcgcgctctggccaatcagctcgttctgctcctgaactcggtgggcgtctctgctgtgaagctcggccacgactccggggtttacagggtgtacatcaatgaggagctgccattcgtcaagctcgataagaagaagaacgcttactacagccatgtgattcctaaggaggtcctctcggaggtcttcggcaaggttttccagaagaacgtgtccccacagaccttccggaagatggtcgaggacggcaggctggatcctgagaaggctcagaggctgtcgtggctcatcgagggggacgtggtcctcgatcgcgtcgagtctgttgacgtggaggactacgatggctacgtgtacgatctctctgtggaggataatgagaacttcctcgtgggcttcgggctcgtttacgctcataat

SEQ ID NO: 670 - DNA, 558 bp, Artificial Sequence
  Synthetic construct Tvo_VMA codon optimized
tgcgtttcgggggagacgccagtctacctcgctgacggcaagacaattaagatcaaggacctctactcatctgagcgcaagaaggaggacaacatcgtcgaggctggctccggggaggagatcattcacctcaaggacccgatccagatctacagctacgttgatggcacgatcgtgcgctcccgctcccgcctcctgtacaaggggaagtccagctacctggtgcgcatcgagacaattggcgggcgctcagtgtccgtcactcccgtccataagctcttcgttctgaccgagaagggcatcgaggaggttatggcctcgaatctcaaagtgggggacatgattgctgctgtcgctgagagcgagtcggaggcccgggattgcggcatgagcgaggagtgcgtgatggaggcggaggtctacacctctctggaggctacgttcgaccgcgttaagtcaatcgcgtacgagaagggcgacttcgatgtgtacgatctgtcagttccagagtacggcaggaacttcattgggggggaggggctgctcgtgctccacaac

SEQ ID NO: 671 - DNA, 456 bp, Artificial Sequence
  Synthetic construct Tvu_DnaE-n_NC-terminal codon optimized
tgcctctcaggggagactgcggttatgacggtggagtacggggctattcctattcggcggctggttcaggagcggctgatctgccaggtttactcgctcgacccacagggccacctgtacacgcagcctatcgctcagtggcatttccagggcttccgcccggtgtacgcgtaccagctggaggacgggtccacaatttgcgctactccggatcaccggttcatgaccacgagcggccagatgctgcccatcgagcagattttccgcgaggggctggagctgtggcaggtggccatcgctccaccaggcgctctcgctcaggggctgaagccggccgtccagatgtcctgcatgaagattgtgggcaggaggctcgtcgggtggcaggctgtttacgatattgggctcgccggggatcataacttcctcctcgctaatggggctattgctgctaat

SEQ ID NO: 672 - DNA, 921 bp, Artificial Sequence
  Synthetic construct Unc-ERS_RIR1 codon optimized
tgcgttaccgctgacacatgggttactaccgctgaggggccaaggcaggtggaggagctgatcggcaagaagttcacggctatcgttaacggcgaggagtgggagtccagcgaggaggggttcttcgagacagacgttaagccagtgtacaccctgaagacggctgagggcttcgagctgaggctcacggctgatcaccctgtcatgaaggttgagaggatgacacggtacaaggtggagactcagtggtccaacgctggcgacctcaagccaggggataagatcattatcaacaatcatagggacttcggcaattggagcgtcaaggggaagtacaccgagggcgaggggtacctgattggcctcctgctcggcgacgggacgatcaagaagctcaacccctggatgaaggcgatttcaaagaagatggagaaggcctccgcggatttctgcgagggcatcctgagggggctcttcgacgctgatggctctgtgcaggggaatcagtcgaagggcgtctctattcgcctggcccagtcagacgtcgagatcctcaaggcggttcagcgcattctgctcaggttcggcatcttctcgaaggtgtacatgaaccgcaggggcgagcggaaggttaagatgccggatgggaagggcggggtcaaggagtacatcaccaagccccagcacgagctcgtgatcagcaacgacaatatcctctacttcgctgagagggtcggcttctcggatgccgagaagatggagaagctggagaaggctatctggaactacaagcggaagatgaatagggagaggttcgtggctagcgtcgaggaggtggtcccagacggcgttgagaaggtgtacgacgttaagattccaggcatcaatgctttcaatgctaatggcttcgtggttcacaac

SEQ ID NO: 673 - DNA, 921 bp, Artificial Sequence
  Synthetic construct Unc-ERS_RIR1_var7
tgcgttaccgctgacacatgggttactaccgctgaggggccaaggcaggtggaggagttgatcggcaagaagttcacggctatcgttaacggcgaggagtgggagtccagcgaggaggggttcttcgagacagacgttaagccagtgtacaccctgaagacggctgagggcttcgagctgaggctcacggctgatcaccctgtcatgaaggttgagaggatgacacggtacaaggtggagactcagtggtccaacgctggcgacctcaagccaggggataagatcattatcaacaatcatagggacttcggcaattggagcgtcaaggggaagtacaccgagggcgaggggtacctgattggcctcctgctcggcgacgggacgatcaagaagctcaacccctggatgaaggcgatttcaaagaagatggagaaggcctccgcagatttctgcgagggcatcctgagggggctctccgacgctgatggctctgtgcaggggaatcagtcgaagggcgtctctattcgcctggcccagtcagacgtcgagatcctcaaggcggttcagcgcattctgctcaggttcggcatcttctcgaaggtgtacatgaaccgcaggggcgagcggaaggttaagatgccggatgggaagggcggggtcaaggagtacatcaccaagccccagcacgagctcgtgatcagcaacgacaatatcctctacttcgctgagagggtcggcttctcggatgccgagaagatggagaagctggagaaggctatctggaactacaagcggaagatgaatagggagaggttcgtggctagcgtcgaggaggtggtcccagacggcgttgagaaggtgtacgacgttaagattccaggcatcaatgctttcaatgctaatggcttcgtggttcacaac

SEQ ID NO: 674 - DNA, 264 bp, Artificial Sequence
  Synthetic construct gp41-1-N codon optimized
tgtctggacctgaaaacgcaagtgcaaaccccgcaaggcatgaaggaaatctcaaacatccaagtcggtgacctggtgctgtcgaataccggctataacgaagtgctgaatgtttttccgaagagcaaaaagaaatcttacaagatcacgctggaagatggcaaggaaattatttgcagcgaagaacatctgttcccgacccagacgggcgaaatgaatatctccggcggtctgaaagaaggcatgtgtctgtacgtcaaggaa

SEQ ID NO: 675 - DNA, 111 bp, Artificial Sequence
  Synthetic construct gp41-1-C codon optimized
atgatgctgaagaaaattctgaagatcgaagaactggatgaacgtgaactgattgacatcgaagttagcggcaaccatctgttttacgcgaatgacattctgacccacaac

SEQ ID NO: 676 - DNA, 273 bp, Artificial Sequence
  Synthetic construct gp41-8-N codon optimized
tgtctgtccctggatacgatggttgtgacgaatggcaaggctattgaaatccgtgatgtgaaagtgggcgactggctggaaagcgaactgggcccggtgcaggttaccgaagtcctgccgattatcaaacaaccggtttttgaaattgtcctgaaaagcaagtctggcaaaaagatccgtgtgagcgcaaaccataaattcccgaccaaggatggtctgaaaacgattaatagtggcctgaaggttggtgactttctgcgttcccgcgcgaaa

SEQ ID NO: 677 - DNA, 135 bp, Artificial Sequence
  Synthetic construct gp41-8-C codon optimized
atgtgcgaaattttcgaaaacgaaatcgattgggacgaaattgccagcatcgaatatgtcggcgtggaagaaaccattgatatcaacgttacgaatgaccgcctgtttttcgcgaacggtatcctgacgcacaat

SEQ ID NO: 678 - DNA, 303 bp, Artificial Sequence
  Synthetic construct IMPDH-1-N codon optimized
tgctttgtcccgggcacgctggtgaataccgaaaatggtctgaaaaagattgaagaaattaaagtgggcgataaggtgtttagtcataccggcaaactgcaagaagtggttgatacgctgatttttgatcgtgacgaagaaattatcagtattaacggtatcgactgcaccaagaaccatgaattttacgtgatcgataaggaaaacgcgaatcgtgttaacgaagacaatatccatctgttcgcgcgctgggtccacgccgaagaactggatatgaaaaagcacctgctgatcgaactggaa

SEQ ID NO: 679 - DNA, 120 bp, Artificial Sequence
  Synthetic construct IMPDH-1-C codon optimized
atgaagttcaagctgaaggaaatcaccagcatcgaaacgaaacattataagggcaaagttcacgatctgaccgtcaaccaagaccattcttacaatgttcgcggtacggtcgtgcacaac

SEQ ID NO: 680 - DNA, 315 bp, Artificial Sequence
  Synthetic construct NrdJ-1-N codon optimized
tgcctggtcggtagcagcgaaatcatcacgcgcaactatggtaaaacgacgatcaaggaagtggtggaaatctttgacaacgataaaaacattcaggtcctggcgtttaacacccatacggataatattgaatgggccccgatcaaagcggcccaactgacccgtccgaatgcagaactggttgaactggaaattgacacgctgcatggcgtcaaaaccatccgctgcacgccggatcacccggtctataccaagaaccgtggttacgtgcgcgctgacgaactgacggatgacgatgaactggtggttgcaatt

SEQ ID NO: 681 - DNA, 120 bp, Artificial Sequence
  Synthetic construct NrdJ-1-C codon optimized
atggaagctaaaacctatatcggcaaactgaagagccgtaagattgtgtctaacgaagacacctacgatatccagaccagtacgcataactttttcgcaaatgatatcctggttcacaat

SEQ ID NO: 682 - protein, 354 aa, Artificial sequence
  proSavinase H62A
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGAGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 683 - DNA, 1062 bp, Artificial sequence
  proSavinase H62A
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatggggctggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 684 - protein, 419 aa, Artificial Sequence
  Synthetic construct, mVMA:P77cd protein
CFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHN

SEQ ID NO: 685 - protein, 336 aa, Artificial Sequence
  Synthetic construct mTth:P77Cd
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHN

SEQ ID NO: 686 - protein, 799 aa, Artificial Sequence
  Synthetic construct, iproSavS135:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 687 - protein, 799 aa, Artificial Sequence
  Synthetic construct, iproSavS265:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 688 - protein, 799 aa, Artificial Sequence
  Synthetic construct, iproSavS269:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 689 - protein, 799 aa, Artificial Sequence
  Synthetic construct, iproSavS293:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 690 - protein, 799 aa, Artificial Sequence
  Synthetic construct, iproSavS312:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSTYPGSTYASLNGTSMATPHVAGAAALVKQKNPSWSNVQIRNHLKNTATSLGSTNLYGSGLVNAEAATR

SEQ ID NO: 691 - protein, 799 aa, Artificial Sequence
  Synthetic construct, iproSavS317:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSTYASLNGTSMATPHVAGAAALVKQKNPSWSNVQIRNHLKNTATSLGSTNLYGSGLVNAEAATR

SEQ ID NO: 692 - protein, 799 aa, Artificial Sequence
  Synthetic construct, iproSavS326:mVMA:P77Cd protein
MKKPLGKIVASTALLISVAFSSSIASAAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHNSMATPHVAGAAALVKQKNPSWSNVQIRNHLKNTATSLGSTNLYGSGLVNAEAATR

SEQ ID NO: 693 - protein, 690 aa, Artificial Sequence
  Synthetic construct iproSavS135:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 694 - protein, 690 aa, Artificial Sequence
  Synthetic construct iproSavS269:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSISYPARYANAMAVGATDQNNNRASFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 695 - protein, 690 aa, Artificial Sequence
  Synthetic construct iproSavS293:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRACLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSFSQYGAGLDIVAPGVNVQSTYPGSTYASLNGTSMATPHVAGAAALVKQKNPSWSNVQIRNHLKNTATSLGSTNLYGSGLVNAEAATR

SEQ ID NO: 696 - protein, 690 aa, Artificial Sequence
  Synthetic construct iproSavS317:mTth:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGCLAEGSLVLDAATGQRVPIEKVRPGMEVFSLGPDYRLYRVPVLEVLESGVREVVRLRTRSGRTLVLTPDHPLLTPEGWKPLCDLPLGTPIAVQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRDVETGEVLWDPIVAVEPAGKARTFDLRVPPFANFVSEDLVVHNSTYASLNGTSMATPHVAGAAALVKQKNPSWSNVQIRNHLKNTATSLGSTNLYGSGLVNAEAATR

SEQ ID NO: 697 - protein, 796 aa, Artificial Sequence
  Synthetic construct iproSavS312:mVMA-c:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQAFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHASTYPGSTYASLNGTSMATPHVAGAAALVKQKNPSWSNVQIRNHLKNTATSLGSTNLYGSGLVNAEAATR

SEQ ID NO: 698 - protein, 796 aa, Artificial Sequence
  Synthetic construct iproSavS326:mVMA-c:P77Cd
MAEEAKEKYLIGFNEQEAVSEFVEQVEANDEVAILSEEEEVEIELLHEFETIPVLSVELSPEDVDALELDPAISYIEEDAEVTTMAQSVPWGISRVQAPAAHNRGLTGSGVKVAVLDTGISTHPDLNIRGGASFVPGEPSTQDGNGHGTHVAGTIAALNNSIGVLGVAPSAELYAVKVLGASGSGSVSSIAQGLEWAGNNGMHVANLSLGSPSPSATLEQAVNSATSRGVLVVAASGNSGAGSISYPARYANAMAVGATDQNNNRASFSQYGAGLDIVAPGVNVQSTYPGSTYASLNGTAFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPFLKKLSKLLLVVLLVAVYTQVNAQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSRGFYFELQELKEDDYYGITLSDDSDHQFLLANQVVVHASMATPHVAGAAALVKQKNPSWSNVQIRNHLKNTATSLGSTNLYGSGLVNAEAATR

SEQ ID NO: 699 - DNA, 1257 bp, Artificial Sequence
  Synthetic construct, mVMA:P77cd DNA
tgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataat

SEQ ID NO: 700 - DNA, 1008 bp, Artificial Sequence
  Synthetic construct mTth:P77Cd
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataac

SEQ ID NO: 701 - DNA, 2400 bp, Artificial Sequence
  Synthetic construct, iproSavS135:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 702 - DNA, 2400 bp, Artificial Sequence
  Synthetic construct, iproSavS265:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 703 - DNA, 2400 bp, Artificial Sequence
  Synthetic construct, iproSavS269:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 704 - DNA, 2400 bp, Artificial Sequence
  Synthetic construct, iproSavS293:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataatagcttttcacagtatggcgcaggccttgacattgtcgcacccggggtaaacgtgcagagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 705 - DNA, 2400 bp, Artificial Sequence
  Synthetic construct, iproSavS312:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagtgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataatagcacatacccaggttcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 706 - DNA, 2400 bp, Artificial Sequence
  Synthetic construct, iproSavS317:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcaacatatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 707 - DNA, 2400 bp, Artificial Sequence
  Synthetic construct, iproSavS326:mVMA:P77Cd DNA
atgaagaaaccgttggggaaaattgtcgcaagcaccgcactactcatttctgttgcttttagttcatcgatcgcatcggctgctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccatggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacatatgccagcttaaacggtacatgctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccataattcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgttaa

SEQ ID NO: 708 - DNA, 2070 bp, Artificial Sequence
  Synthetic construct iproSavS135:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataactctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 709 - DNA, 2070 bp, Artificial Sequence
  Synthetic construct iproSavS269:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataactcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 710 - DNA, 2070 bp, Artificial Sequence
  Synthetic construct iproSavS293:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgcttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataacagcttttcacagtatggcgcaggccttgacattgtcgcacccggggtaaacgtgcagagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 711 - DNA, 2070 bp, Artificial Sequence
  Synthetic construct iproSavS317:mTth:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctagagatgttgagactggagaggttctctgggaccctattgttgctgtcgaaccggccggtaaggcgagaacattcgacttgcgcgttccaccctttgcaaacttcgtgagcgaggacctggtggtgcataactcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 712 - DNA, 2388 bp, Artificial Sequence
  Synthetic construct iproSavS312:mVMA-c:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcaggcctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccattccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccatgccagcacatacccaggttcaacttatgccagcttaaacggtacatcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 713 - DNA, 2388 bp, Artificial Sequence
  Synthetic construct iproSavS326:mVMA-c:P77Cd
atggctgaagaagcaaaagaaaaatatttaattggctttaatgagcaggaagctgtcagtgagtttgtagaacaagtagaggcaaatgacgaggtcgccattctctctgaggaagaggaagtcgaaattgaattgcttcatgaatttgaaacgattcctgttttatccgttgagttaagcccagaagatgtggacgcgcttgaactcgatccagcgatttcttatattgaagaggatgcagaagtaacgacaatggcgcaatcggtaccttggggaattagccgtgtgcaagccccagctgcccataaccgtggattgacaggttctggtgtaaaagttgctgtcctcgatacagggatatccactcatccagatctaaatattcgtggtggcgcaagctttgtaccaggggaaccgtcgactcaagatgggaatgggcatggcacgcatgtggccgggacgatcgctgctttaaacaattcgattggcgttcttggcgtagcgccgagcgctgagctatacgctgttaaagtcctaggggcgagcggttcaggttcggtcagctcgattgcccaaggattggaatgggcagggaacaatggcatgcacgttgctaatttgagtttaggaagcccttcgccaagtgccacacttgagcaagctgttaatagcgcgacttctagaggcgttcttgttgtagcggcatctgggaactcaggtgcaggctcaatcagctatccggcgcgctatgcgaacgcaatggcagtcggagctactgatcaaaacaacaaccgcgctagcttttcacagtatggcgcaggccttgacattgtcgcacccggggtaaacgtgcagagcacatacccaggttcaacttatgccagcttaaacggtacagcctttgccaagggtaccaatgttttaatggcggatgggtctattgaatgtattgaaaacattgaggttggtaataaggtcatgggtaaagatggcagacctcgtgaggtaattaaattgcccagaggaagagaaactatgtacagcgtcgtgcagaaaagtcagcacagagcccacaaaagtgactcaagtcgtgaagtgccagaattactcaagtttacgtgtaatgcgacccatgagttggttgttagaacacctcgtagtgtccgccgtttgtctcgtaccattaagggtgtcgaatattttgaagttattacttttgagatgggccaaaagaaagcccccgacggtagaattgttgagcttgtcaaggaagtttcaaagagctacccaatatctgaggggcctgagagagccaacgaattagtagaatcctatagaaaggcttcaaataaagcttattttgagtggactattgaggccagagatctttctctgttgggttcccatgttcgtaaagctacctaccagacttacgctccattccttaagaaactgtctaagttgctgctcgtcgtgctccttgttgccgtttacacacaggtcaacgcgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcgcggattttatttcgagttacaagaattgaaggaagacgattattatgggattactttatctgatgattctgatcatcagtttttgcttgccaaccaggttgtcgtccatgcctcgatggctactcctcatgttgcaggtgcggccgcccttgttaaacaaaagaacccatcttggtctaatgtacaaattcgaaatcatctaaagaatacggcaactagtttaggaagcacgaacttgtatggaagcggacttgttaacgcagaagcggcaacgcgt

SEQ ID NO: 714 - protein, 201 aa, Artificial Sequence
  Synthetic construct, P77853Cd protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFS

SEQ ID NO: 715 - protein, 178 aa, Artificial Sequence
  Synthetic construct, EU591743 protein
MFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVS

SEQ ID NO: 716 - DNA, 606 bp, Artificial Sequence
  Synthetic construct, P77853cd (P77Cd) DNA
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctcttag

SEQ ID NO: 717 - DNA, 537 bp, Artificial Sequence
  Synthetic construct, EU591743 (EU59) DNA
atgttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatga

SEQ ID NO: 718 - protein, 409 aa, Trichoderma reesei
  MISC_FEATURE (1)..(409): Acid fungal protease
MQTFGAFLVSFLAASGLAAALLPTEGQKTASVEVQYNKNYVPHGPTALFKAKRKYGAPISDNLKSLVAARQAKQALAKRQTGSAPNHPSDSADSEYITSVSIGTPAQVLPLDFDTGSSDLWVFSSETPKSSATGHAIYTPSKSSTSKKVSGASWSISYGDGSSSSGDVYTDKVTIGGFSVNTQGVESATRVSTEFVQDTVISGLVGLAFDSGNQVRPHPQKTWFSNAASSLAEPLFTADLRHGQNGSYNFGYIDTSVAKGPVAYTPVDNSQGFWEFTASGYSVGGGKLNRNSIDGIADTGTTLLLLLDDNVVDAYYANVQSAQYDNQQEGVVFDCDEDLPSFSFGVGSSTITIPGDLLNLTPLEEGSSTCFGGLQSSSGIGINIFGDVALKAALVVFDLGNERLGWAQK

What is claimed is:

1. A composition comprising:
    a first portion and a second portion of an intein-modified protease, and a detergent;
    the first portion of the intein-modified protease comprising an N-extein of a target protease and an N-intein of an intein, and a carboxy terminus of the N-extein is fused to an amino terminus of the N-intein, wherein the first portion includes a sequence with at least 90% identity to the reference sequence of SEQ ID NO: 454;
    the second portion of the intein-modified protease comprising a C-intein of the intein and a C-extein of the target protease, and a carboxy terminus of the C-intein is fused to an amino terminus of the C-extein, and wherein the second portion includes a sequence with at least 90% identity to the reference sequence SEQ ID NO: 455,
    wherein the detergent inhibits trans-splicing of the intein-modified protease, and the intein is capable of effecting trans-splicing of the intein-modified protease upon dilution of the detergent with water.

2. The composition of claim 1, wherein each of the N-intein and the C-intein is fused in such a position as to substantially reduce or inhibit the activity of the target protease.

3. The composition of claim 2, wherein the target protease restores activity upon splicing of the intein-modified protease.

4. The composition of claim 1, wherein the target protease includes a sequence with at least 90% identity to a sequence of SEQ ID NO: 57.

5. The composition of claim 1, wherein the concentration of the detergent in a dilution with water is a detergent:water ratio less or equal to 1:5 of a detergent to water.

6. The composition of claim 1, wherein the concentration of the detergent in a dilution with water is a detergent:water ratio selected from the group consisting of: 1: 10, 1:20, 1:50: 1:60, 1:70, 1: 80, 1:90, 1:100, 1:150, 1:200, 1:250, 1:300, 1:350, and 1: 400 of a detergent to water.

7. A method of producing a protease comprising causing splicing of the intein-modified protease included in the composition of claim 1 by diluting the detergent with water.

8. The method of claim 7, wherein the intein is capable of effecting trans-splicing of the intein-modified protease.

9. The method of claim 7, wherein the concentration of the detergent in a dilution with water at a detergent:water ratio less or equal to 1:5 of a detergent to water.

10. The method of claim 9, wherein the concentration of the detergent in a dilution with water is a detergent:water ratio one selected from the group consisting of: 1: 10, 1:20, 1:50: 1:60, 1:70, 1: 80, 1:90, 1:100, 1:150, 1:200, 1:250, 1:300, 1:350, and 1: 400 of a detergent to water.

11. The method of claim 7, wherein the activity of the target protease is substantially reduced or inhibited.

12. The method of claim 11, wherein the target protease restores activity upon splicing of the intein-modified protease.

13. An expression cassette comprising:
    a polynucleotide encoding at least one of i) a first portion of an intein-modified protease that includes an N-extein of a target protease and an N-intein of an intein, and a carboxy terminus of the N-extein is fused to an amino terminus of the N-intein, wherein sequence encoding the first portion has at least 90% identity to the sequence of SEQ ID NO: 587; and ii) a second portion of an intein-modified protease having a C-intein of the intein and a C-extein of the target protease, and a carboxy terminus of the C-intein is fused to an amino terminus of the C-extein wherein the sequence encoding the second portion has at least 90% identity to the sequence of SEQ ID NO: 588, and
    the intein is capable of effecting trans-splicing of the intein-modified protease, wherein the ability of the intein to effect trans-splicing is inhibited by a detergent, and is restored upon dilution of the detergent with water.

14. The expression cassette of claim 13, wherein the N-intein or the C-intein is fused in such a position as to substantially reduce or inhibit the activity of the target protease.

15. The expression cassette of claim 14, wherein the activity of the target protease is restored upon trans-splicing of the intein-modified protease.

16. The expression cassette of claim 13, wherein the polynucleotide comprises a sequence with at least 90% identity to the reference sequence of SEQ ID NO: 59.

17. A host genetically engineered to express the polynucleotide included in the expression cassette of claim 13.

18. The host of claim 17, wherein the host is selected from the group consisting of: a plant cell, a microbial cell, a fungal cell, a mammalian cell, a phage, a virus, and an insect cell.

19. The host of claim 17, wherein the host is a microorganism selected from the group consisting of: *Bacillus subtilus, Bacillus lentus, Bacillus licheniformis, Escherichia coli, Saccharomyces* ssp., *Saccharomyces cerevisiae, Pichia* ssp., and *Pichia pastoris.*

20. The host of claim 17, wherein the host is a plant selected from the group consisting of: corn, soy beans, sorghum, switchgrass, sugarcane, wheat, alfalfa, barley, and rice.

\* \* \* \* \*